United States Patent
Schellenberger et al.

(10) Patent No.: US 9,371,369 B2
(45) Date of Patent: *Jun. 21, 2016

(54) EXTENDED RECOMBINANT POLYPEPTIDES AND COMPOSITIONS COMPRISING SAME

(71) Applicant: Amunix Operating Inc., Mountain View, CA (US)

(72) Inventors: Volker Schellenberger, Palo Alto, CA (US); Joshua Silverman, Sunnyvale, CA (US); Chia-Wei Wang, Milpitas, CA (US); Benjamin Spink, San Carlos, CA (US); Willem P. Stemmer, Los Gatos, CA (US); Nathan Geething, Santa Clara, CA (US); Wayne To, Fremont, CA (US); Jeffrey L. Cleland, San Carlos, CA (US)

(73) Assignee: Amunix Operating Inc., Mountain View, CA (US)

(*) Notice: Subject to any disclaimer, the term of this patent is extended or adjusted under 35 U.S.C. 154(b) by 78 days.

This patent is subject to a terminal disclaimer.

(21) Appl. No.: 14/168,973

(22) Filed: Jan. 30, 2014

(65) Prior Publication Data

US 2014/0301974 A1 Oct. 9, 2014

Related U.S. Application Data

(63) Continuation of application No. 12/699,761, filed on Feb. 3, 2010, now Pat. No. 8,673,860.

(60) Provisional application No. 61/149,669, filed on Feb. 3, 2009, provisional application No. 61/268,193, filed (Continued)

(51) Int. Cl.
*A61K 38/16* (2006.01)
*A61K 38/18* (2006.01)

(Continued)

(52) U.S. Cl.
CPC .............. *C07K 14/545* (2013.01); *C07K 14/001* (2013.01); *C07K 14/47* (2013.01);

(Continued)

(58) Field of Classification Search
CPC .... C07K 14/001; C07K 14/47; C07K 14/545; C07K 14/605; C07K 14/61; C07K 14/745; C07K 2319/31; C07K 2319/35
See application file for complete search history.

(56) References Cited

U.S. PATENT DOCUMENTS 3,992,518 A 11/1976 Chien et al.
4,088,864 A 5/1978 Theeuwes et al.

(Continued)

FOREIGN PATENT DOCUMENTS

CN 1761684 A 4/2006
CN 1933855 A 3/2007

(Continued)

OTHER PUBLICATIONS

Kangueane; et al., "T-Epitope Designer: A HLA-peptide binding prediction server.", May 15, 2005, 1(1), 21-4.

(Continued)

*Primary Examiner* — James H Alstrum Acevedo
*Assistant Examiner* — Randall L Beane
(74) *Attorney, Agent, or Firm* — Wilson Sonsini Goodrich & Rosati

(57) ABSTRACT

The present invention relates to compositions comprising biologically active proteins linked to extended recombinant polypeptide (XTEN), isolated nucleic acids encoding the compositions and vectors and host cells containing the same, and methods of using such compositions in treatment of glucose-related diseases, metabolic diseases, coagulation disorders, and growth hormone-related disorders and conditions.

37 Claims, 48 Drawing Sheets

Related U.S. Application Data on Jun. 8, 2009, provisional application No. 61/185,112, filed on Jun. 8, 2009, provisional application No. 61/236,493, filed on Aug. 24, 2009, provisional application No. 61/236,836, filed on Aug. 25, 2009, provisional application No. 61/243,707, filed on Sep. 18, 2009, provisional application No. 61/245,490, filed on Sep. 24, 2009, provisional application No. 61/280,955, filed on Nov. 10, 2009, provisional application No. 61/280,956, filed on Nov. 10, 2009, provisional application No. 61/281,109, filed on Nov. 12, 2009.

(51) Int. Cl.

| | | |
|---|---|---|
| *C07K 14/61* | (2006.01) | |
| *C07K 14/46* | (2006.01) | |
| *C07K 14/545* | (2006.01) | |
| *C07K 14/00* | (2006.01) | |
| *C07K 14/605* | (2006.01) | |
| *C07K 14/745* | (2006.01) | |
| *C07K 14/47* | (2006.01) | |

(52) U.S. Cl.
CPC ............ *C07K 14/605* (2013.01); *C07K 14/61* (2013.01); *C07K 14/745* (2013.01); *C07K 2319/31* (2013.01); *C07K 2319/35* (2013.01)

(56) References Cited

U.S. PATENT DOCUMENTS

| | | |
|---|---|---|
| 4,200,984 A | 5/1980 | Fink |
| 4,284,444 A | 8/1981 | Bernstein et al. |
| 4,398,908 A | 8/1983 | Siposs |
| 4,435,173 A | 3/1984 | Siposs et al. |
| 4,542,025 A | 9/1985 | Tice et al. |
| 4,599,311 A | 7/1986 | Kawasaki |
| 4,684,479 A | 8/1987 | D'Arrigo |
| 4,713,339 A | 12/1987 | Levinson et al. |
| 4,757,006 A | 7/1988 | Toole, Jr. et al. |
| 4,845,075 A | 7/1989 | Murray et al. |
| 4,861,800 A | 8/1989 | Buyske |
| 4,870,008 A | 9/1989 | Brake |
| 4,882,279 A | 11/1989 | Cregg |
| 4,897,268 A | 1/1990 | Tice et al. |
| 4,931,373 A | 6/1990 | Kawasaki et al. |
| 4,933,185 A | 6/1990 | Wheatley et al. |
| 4,965,199 A | 10/1990 | Capon et al. |
| 4,976,696 A | 12/1990 | Sanderson et al. |
| 4,988,337 A | 1/1991 | Ito |
| 5,004,804 A | 4/1991 | Kuo et al. |
| 5,017,378 A | 5/1991 | Turner et al. |
| 5,037,743 A | 8/1991 | Welch et al. |
| 5,089,474 A | 2/1992 | Castro et al. |
| 5,112,950 A | 5/1992 | Meulien et al. |
| 5,171,844 A | 12/1992 | van Ooyen et al. |
| 5,176,502 A | 1/1993 | Sanderson et al. |
| 5,186,938 A | 2/1993 | Sablotsky et al. |
| 5,198,349 A | 3/1993 | Kaufman |
| 5,215,680 A | 6/1993 | D'Arrigo |
| 5,223,409 A | 6/1993 | Ladner et al. |
| 5,250,421 A | 10/1993 | Kaufman et al. |
| 5,270,176 A | 12/1993 | Dorschug et al. |
| 5,298,022 A | 3/1994 | Bernardi |
| 5,318,540 A | 6/1994 | Athayde et al. |
| 5,364,934 A | 11/1994 | Drayna et al. |
| 5,407,609 A | 4/1995 | Tice et al. |
| 5,424,199 A | 6/1995 | Goeddel et al. |
| 5,492,534 A | 2/1996 | Athayde et al. |
| 5,534,617 A | 7/1996 | Cunningham et al. |
| 5,543,502 A | 8/1996 | Nordfang et al. |
| 5,554,730 A | 9/1996 | Woiszwillo et al. |
| 5,573,776 A | 11/1996 | Harrison et al. |
| 5,576,291 A | 11/1996 | Curtis et al. |
| 5,578,709 A | 11/1996 | Woiszwillo |
| 5,599,907 A | 2/1997 | Anderson et al. |
| 5,610,278 A | 3/1997 | Nordfang et al. |
| 5,660,848 A | 8/1997 | Moo-Young |
| 5,756,115 A | 5/1998 | Moo-Young et al. |
| 5,789,379 A | 8/1998 | Drucker et al. |
| 5,833,911 A | 11/1998 | Llort et al. |
| 5,874,104 A | 2/1999 | Adler-Moore et al. |
| 5,916,588 A | 6/1999 | Popescu et al. |
| 5,919,766 A | 7/1999 | Osterberg et al. |
| 5,942,252 A | 8/1999 | Tice et al. |
| 5,965,156 A | 10/1999 | Proffitt et al. |
| 5,972,885 A | 10/1999 | Spira et al. |
| 5,981,719 A | 11/1999 | Woiszwillo et al. |
| 6,024,983 A | 2/2000 | Tice et al. |
| 6,043,094 A | 3/2000 | Martin et al. |
| 6,048,720 A | 4/2000 | Dalborg et al. |
| 6,056,973 A | 5/2000 | Allen et al. |
| 6,060,447 A | 5/2000 | Chapman et al. |
| 6,090,925 A | 7/2000 | Woiszwillo et al. |
| 6,110,498 A | 8/2000 | Rudnic et al. |
| 6,126,966 A | 10/2000 | Abra et al. |
| 6,183,770 B1 | 2/2001 | Muchin et al. |
| 6,251,632 B1 | 6/2001 | Lillicrap et al. |
| 6,254,573 B1 | 7/2001 | Haim et al. |
| 6,268,053 B1 | 7/2001 | Woiszwillo et al. |
| 6,284,276 B1 | 9/2001 | Rudnic et al. |
| 6,294,170 B1 | 9/2001 | Boone et al. |
| 6,294,191 B1 | 9/2001 | Meers et al. |
| 6,294,201 B1 | 9/2001 | Kettelhoit et al. |
| 6,303,148 B1 | 10/2001 | Hennink et al. |
| 6,309,370 B1 | 10/2001 | Haim et al. |
| 6,316,024 B1 | 11/2001 | Allen et al. |
| 6,316,226 B1 | 11/2001 | Van Ooyen et al. |
| 6,329,186 B1 | 12/2001 | Nielsen et al. |
| 6,346,513 B1 | 2/2002 | Van Ooyen et al. |
| 6,352,716 B1 | 3/2002 | Janoff et al. |
| 6,352,721 B1 | 3/2002 | Faour |
| 6,361,796 B1 | 3/2002 | Rudnic et al. |
| 6,395,302 B1 | 5/2002 | Hennink et al. |
| 6,406,632 B1 | 6/2002 | Safir et al. |
| 6,406,713 B1 | 6/2002 | Janoff et al. |
| 6,458,387 B1 | 10/2002 | Scott et al. |
| 6,458,563 B1 | 10/2002 | Lollar |
| 6,514,532 B2 | 2/2003 | Rudnic et al. |
| 6,517,859 B1 | 2/2003 | Tice et al. |
| 6,534,090 B2 | 3/2003 | Puthli et al. |
| 6,572,585 B2 | 6/2003 | Choi |
| 6,669,961 B2 | 12/2003 | Kim et al. |
| 6,713,086 B2 | 3/2004 | Qiu et al. |
| 6,715,485 B1 | 4/2004 | Djupesland |
| 6,733,753 B2 | 5/2004 | Boone et al. |
| 6,743,211 B1 | 6/2004 | Prausnitz et al. |
| 6,759,057 B1 | 7/2004 | Weiner et al. |
| 6,814,979 B2 | 11/2004 | Rudnic et al. |
| 6,818,439 B1 | 11/2004 | Jolly et al. |
| 6,838,093 B2 | 1/2005 | Flanner et al. |
| 6,890,918 B2 | 5/2005 | Burnside et al. |
| 6,905,688 B2 | 6/2005 | Rosen et al. |
| 6,919,311 B2 | 7/2005 | Lenting et al. |
| 6,945,952 B2 | 9/2005 | Kwon |
| 7,045,318 B2 | 5/2006 | Ballance |
| 7,276,475 B2 | 10/2007 | Defrees et al. |
| 7,294,513 B2 | 11/2007 | Wyatt |
| 7,329,640 B2 | 2/2008 | Vlasuk |
| 7,413,537 B2 | 8/2008 | Ladner et al. |
| 7,442,778 B2 | 10/2008 | Gegg et al. |
| 7,452,967 B2 | 11/2008 | Bertin |
| 7,511,024 B2 | 3/2009 | Pederson et al. |
| 7,514,257 B2 | 4/2009 | Lee et al. |
| 7,528,242 B2 | 5/2009 | Anderson et al. |
| 7,560,107 B2 | 7/2009 | Lollar |
| 7,709,605 B2 | 5/2010 | Knopf et al. |
| 7,846,445 B2 | 12/2010 | Schellenberger et al. |
| 8,129,348 B2 | 3/2012 | Besman et al. |
| 8,178,495 B2 | 5/2012 | Chilkoti |
| 8,492,530 B2 | 7/2013 | Schellenberger et al. |
| 8,557,961 B2 | 10/2013 | Silverman et al. |
| 8,673,860 B2 | 3/2014 | Schellenberger et al. |
| 8,680,050 B2 | 3/2014 | Schellenberger et al. |

(56) References Cited

U.S. PATENT DOCUMENTS

| | | |
|---|---|---|
| 8,703,717 B2 | 4/2014 | Schellenberger et al. |
| 8,716,448 B2 | 5/2014 | Schellenberger et al. |
| 8,957,021 B2 | 2/2015 | Schellenberger et al. |
| 2002/0042079 A1 | 4/2002 | Simon et al. |
| 2002/0150881 A1 | 10/2002 | Ladner et al. |
| 2003/0049689 A1 | 3/2003 | Edwards et al. |
| 2003/0181381 A1 | 9/2003 | Himmelspach et al. |
| 2003/0190740 A1 | 10/2003 | Altman |
| 2003/0228309 A1 | 12/2003 | Salcedo et al. |
| 2004/0043446 A1 | 3/2004 | DeFrees et al. |
| 2004/0106118 A1 | 6/2004 | Kolmar et al. |
| 2004/0142870 A1 | 7/2004 | Finn |
| 2004/0259780 A1 | 12/2004 | Glasebrook et al. |
| 2005/0032081 A1 | 2/2005 | Ju et al. |
| 2005/0042721 A1 | 2/2005 | Fang et al. |
| 2005/0048512 A1 | 3/2005 | Kolkman et al. |
| 2005/0118136 A1 | 6/2005 | Leung et al. |
| 2005/0123997 A1 | 6/2005 | Lollar |
| 2005/0260605 A1 | 11/2005 | Punnonen et al. |
| 2005/0287153 A1 | 12/2005 | Dennis |
| 2006/0026719 A1 | 2/2006 | Kieliszewski et al. |
| 2006/0040856 A1 | 2/2006 | DeFrees et al. |
| 2006/0084113 A1 | 4/2006 | Ladner et al. |
| 2006/0122376 A1 | 6/2006 | Chapman et al. |
| 2006/0211621 A1 | 9/2006 | Knudsen et al. |
| 2006/0287220 A1 | 12/2006 | Li et al. |
| 2006/0293232 A1 | 12/2006 | Levy et al. |
| 2007/0048282 A1 | 3/2007 | Rosen et al. |
| 2007/0161087 A1 | 7/2007 | Glaesner et al. |
| 2007/0191272 A1 | 8/2007 | Stemmer et al. |
| 2007/0203058 A1 | 8/2007 | Lau et al. |
| 2007/0212703 A1 | 9/2007 | Stemmer et al. |
| 2007/0244301 A1 | 10/2007 | Siekmann et al. |
| 2008/0039341 A1 | 2/2008 | Schellenberger et al. |
| 2008/0167238 A1 | 7/2008 | Rosen et al. |
| 2008/0176288 A1 | 7/2008 | Leung et al. |
| 2008/0193441 A1 | 8/2008 | Trown et al. |
| 2008/0227691 A1 | 9/2008 | Ostergaard et al. |
| 2008/0234193 A1 | 9/2008 | Bossard et al. |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0042787 A1 | 2/2009 | Metzner et al. |
| 2009/0060862 A1 | 3/2009 | Chang et al. |
| 2009/0092582 A1 | 4/2009 | Bogin et al. |
| 2009/0099031 A1 | 4/2009 | Stemmer et al. |
| 2009/0117104 A1 | 5/2009 | Baker et al. |
| 2009/0169553 A1 | 7/2009 | Day |
| 2009/0239795 A1 | 9/2009 | Ballance et al. |
| 2009/0280056 A1 | 11/2009 | Dennis et al. |
| 2010/0081615 A1 | 4/2010 | Pan et al. |
| 2010/0189682 A1 | 7/2010 | Schellenberger et al. |
| 2010/0239554 A1 | 9/2010 | Schellenberger et al. |
| 2010/0292130 A1 | 11/2010 | Skerra et al. |
| 2011/0077199 A1 | 3/2011 | Schellenberger et al. |
| 2011/0142859 A1 | 6/2011 | Ebens, Jr. et al. |
| 2011/0151433 A1 | 6/2011 | Schellenberger et al. |
| 2012/0178691 A1 | 7/2012 | Schellenberger et al. |
| 2012/0220011 A1 | 8/2012 | Schellenberger et al. |
| 2012/0230947 A1 | 9/2012 | Schellenberger et al. |
| 2012/0263701 A1 | 10/2012 | Schellenberger et al. |
| 2012/0263703 A1 | 10/2012 | Schellenberger et al. |
| 2013/0017997 A1 | 1/2013 | Schellenberger et al. |
| 2013/0039884 A1 | 2/2013 | Bogin et al. |
| 2013/0137763 A1 | 5/2013 | Van Delft et al. |
| 2013/0165389 A1 | 6/2013 | Schellenberger et al. |
| 2013/0183280 A1 | 7/2013 | Oestergaard et al. |
| 2014/0162949 A1 | 6/2014 | Cleland et al. |

FOREIGN PATENT DOCUMENTS

| | | |
|---|---|---|
| CN | 101190945 A | 6/2008 |
| DE | 257197 A1 | 6/1988 |
| EP | 0036776 A2 | 9/1981 |
| EP | 0036776 A3 | 10/1982 |
| EP | 0184438 A2 | 6/1986 |
| EP | 0238023 A2 | 9/1987 |
| EP | 0244234 A2 | 11/1987 |
| EP | 0184438 A3 | 1/1988 |
| EP | 0244234 A3 | 10/1988 |
| EP | 0295597 A2 | 12/1988 |
| EP | 0238023 A3 | 2/1989 |
| EP | 0295597 A3 | 5/1990 |
| EP | 0272277 B1 | 9/1993 |
| EP | 0556171 B1 | 8/2000 |
| JP | 2000502901 A | 3/2000 |
| RU | 2005133665 A | 6/2006 |
| WO | 8704187 A1 | 7/1987 |
| WO | 8800831 A1 | 2/1988 |
| WO | WO 89/09051 A1 | 10/1989 |
| WO | 9210576 A1 | 6/1992 |
| WO | 9711178 A1 | 3/1997 |
| WO | WO 97/33552 A1 | 9/1997 |
| WO | 9822577 A1 | 5/1998 |
| WO | 9852976 A1 | 11/1998 |
| WO | WO 99/41383 A1 | 8/1999 |
| WO | WO 99/49901 A1 | 10/1999 |
| WO | 0003317 A1 | 1/2000 |
| WO | 02077036 A2 | 10/2002 |
| WO | 02079232 A2 | 10/2002 |
| WO | 02079232 A3 | 12/2002 |
| WO | WO 2005/025499 A2 | 3/2005 |
| WO | WO 2005/025499 A3 | 5/2005 |
| WO | 2005069845 A2 | 8/2005 |
| WO | 2006024953 A2 | 3/2006 |
| WO | WO 2006/081249 A2 | 8/2006 |
| WO | WO 2006/081249 A3 | 2/2007 |
| WO | 2007073486 A2 | 6/2007 |
| WO | WO 2007/090584 A1 | 8/2007 |
| WO | WO 2007/103455 A2 | 9/2007 |
| WO | WO 2007/103455 A3 | 11/2007 |
| WO | 2008012629 A2 | 1/2008 |
| WO | WO 2008/049931 A1 | 5/2008 |
| WO | WO 2008/077616 A1 | 7/2008 |
| WO | WO 2008/155134 A1 | 12/2008 |
| WO | 2009023270 A2 | 2/2009 |
| WO | WO 2010/091122 A1 | 8/2010 |
| WO | WO 2010/144502 A2 | 12/2010 |
| WO | WO 2010/144508 A1 | 12/2010 |
| WO | WO 2011/028228 A1 | 3/2011 |
| WO | WO 2011/028229 A1 | 3/2011 |
| WO | 2011069164 A2 | 6/2011 |
| WO | WO 2011/084808 A2 | 7/2011 |
| WO | 2011123830 A2 | 10/2011 |
| WO | WO 2011/123813 A2 | 10/2011 |
| WO | 2012006623 A1 | 1/2012 |
| WO | 2012006624 A2 | 1/2012 |
| WO | 2012006633 A1 | 1/2012 |

OTHER PUBLICATIONS

Ackerman et al. Ion Channels—Basic Science and Clinical Disease. New Engl. J. Med.1997; 336:1575-1587.

Adams, et al. High affinity restricts the localization and tumor penetration of single-chain fv antibody molecules. Cancer Res. 2001; 61(12):4750-5.

Adams, et al. Increased affinity leads to improved selective tumor delivery of single-chain Fv antibodies. Cancer Res. 1998; 58(3):485-90.

Alam, et al. Expression and purification of a mutant human growth hormone that is resistant to proteolytic cleavage by thrombin, plasmin and human plasma in vitro. J Biotechnol. 1998; 65(2-3):183-90.

Altschul et al. Basic Local Alignment Search Tool. J. Mol. Biol. 1990; 215:403-410.

Alvarez, et al. Improving Protein Pharmacokinetics by Genetic Fusion to Simple Amino Acid Sequences. J Biol Chem. 2004; 279: 3375-81.

(56) References Cited

OTHER PUBLICATIONS

Amin, et al. Construction of stabilized proteins by combinatorial consensus mutagenesis. Protein Eng Des Sel. 2004; 17: 787-93.

Antcheva, et al. Proteins of circularly permuted sequence present within the same organism: the major serine proteinase inhibitor from Capsicum annuum seeds. Protein Sci. 2001; 10: 2280-90.

Araki, et al. Four disulfide bonds' allocation of Na+, K(+)-ATPase inhibitor (SPAI). Biochemical and biophysical research communications. 1990. 172(1): 42-46. (Abstract Only).

Arap, et al. Steps toward mapping the human vasculature by phage display. Nat Med. 2002; 8: 121-7.

Arnau, et al. Current strategies for the use of affinity tags and tag removal for the purification of recombinant proteins. Protein Expr Purif. 2006; 48(1):1-13.

Arndt, et al. Factors influencing the dimer to monomer transition of an antibody single-chain Fv fragment. Biochemistry. 1998; 37(37):12918-26.

Assadi-Porter, et al. Sweetness determinant sites of brazzein, a small, heat-stable, sweet-tasting protein. Arch Biochem Biophys. 2000; 376:259-265.

Aster, et al. The Folding and Structural Integrity of the first LIN-12 Module of Human Notch1 are Calcium-Dependent. Biochemistry 1999; 38:4736-4742.

Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.

Baneyx, et al. Recombinant protein folding and misfolding in Escherichia coli. Nat Biotechnol. 2004; 22(11):1399-408.

Baron, et al. From cloning to a commercial realization: human alpha interferon. Crit Rev Biotechnol. 1990; 10(3):179-90.

Barta, et al. Repeats with variations: accelerated evolution of the Pin2 family of proteinase inhibitors. Trends Genet. 2002; 18: 600-3.

Bateman, et al. Granulins: the structure and function of an emerging family of growth factors. J Endocrinol. 1998; 158: 145-151.

Beissinger, et al. How chaperones fold proteins. Biol Chem. 1998; 379(3):245-59.

Belew, et al. Purification of recombinant human granulocyte-macrophage colony-stimulating factor from the inclusion bodies produced by transformed Escherichia coli cells. J Chromatogr A. 1994; 679(1):67-83.

Bensch et al. hBD-1: a novel beta-defensin from human plasma. FEBS Lett 1995; 368:331-335.

Berger, et al. Phoenix mutagenesis: one-step reassembly of multiply cleaved plasmids with mixtures of mutant and wild-type fragments. Anal Biochem. 1993; 214: 571-9.

Beste, et al. Small antibody-like proteins with prescribed ligand specificities derived from the lipocalin fold. Proc Natl Acad Sci U S A. 1999; 96: 1898-1903.

Binz, et al. Engineering novel binding proteins from nonimmunoglobulin domains. Nature Biotechnology 2005; 23:1257-68.

Bird, et al. Single-chain antigen-binding proteins. Science. 1988; 242(4877):423-6.

Bittner, et al. Recombinant human erythropoietin (rhEPO) loaded poly(lactide-co-glycolide) microspheres: influence of the encapsulation technique and polymer purity on microsphere characteristics. Eur J Pharm Biopharm. 1998; 45(3):295-305.

Blanchette, et al. Principles of transmucosal delivery of therapeutic agents, Biomedicine & Pharmacotherapy. 2004; 58:142-152.

Bloch, Jr., et al. H NMR structure of an antifungal gamma-thionin protein SI alpha 1: Similarity to scorpion toxins. Proteins. 1998; 32: 334-49.

Bodenmuller, et al. The Neuropeptide Head Activator Loses Its Biological Acitivity by Dimerization. EMBO J. Aug. 1986; 5(8): 1825-1829.

Boder, et al. Directed evolution of antibody fragments with monovalent femtomolar antigen-binding affinity. Proc Natl Acad Sci U S A. 2000; 97(20):10701-5.

Brooks, et al. Evolution of amino acid frequencies in proteins over deep time: inferred order of introduction of amino acids into the genetic code. Mol Biol Evol. 2002; 19, 1645-1655.

Buchner. Supervising the fold: functional principles of molecular chaperones. FASEB J. 1996; 10(1):10-19.

Bulaj, et al. Efficient oxidative folding of conotoxin and the radiation of venomous cone snails. Proc Natl Acad Sci U S A. 2003; 100 Suppl 2:14562-8.

Buscaglia, et al. Tandem amino acid repeats from Trypanosoma cruzi shed antigens increase the half-life of proteins in blood. Blood. Mar. 15, 1999;93(6):2025-32.

Calabrese, et al. Crystal Structure of Phenylalanine Ammonia Lyase: Multiple Helix Dipoles Implicated in Catalysis. Biochemistry. 2004; 43: 11403-16.

Calvete, et al. Disulphide-bond pattern and molecular modelling of the dimeric disintegrin EMF-10, a potent and selective integrin alpha5beta1 antagonist from Eristocophis macmahoni venom. Biochem J. Feb. 1, 2000;345 Pt 3:573-81.

Calvete, et al. Snake venom disintegrins: Evolution of structure and function. Toxicon 2005; 45:1063-1074.

Calvete, et al. Snake venom disintegrins: Novel dimeric disintegrins and structural diversification by disulfphide bond engineering. Biochem J. 2003; 372:725-734.

Cao, et al. Development of a compact anti-BAFF antibody in Escherichia coli. Appl Microbiol Biotechnol. 2006; 73(1):151-7.

Carr, et al. Solution structure of a trefoil-motif-containing cell growth factor, porcine spasmolytic protein. PNAS 1994; 91:2206-2210.

Chen, et al. Crystal structure of a bovine neurophysin II dipeptide complex at 2.8 A determined from the single-wavelength anomalous scattering signal of an incorporated iodine atom. Proc Natl Acad Sci U S A. 1991; 88: 4240-4.

Chen, et al. Expression, purification, and in vitro refolding of a humanized single-chain Fv antibody against human CTLA4 (CD152). Protein Expr Purif. 2006; 46(2):495-502.

Chen, et al. Site-directed mutations in a highly conserved region of Bacillus thuringiensis delta-endotoxin affect inhibition of short circuit current across Bombyx mori midguts. Proc Natl Acad Sci U S A. 1993; 90(19):9041-5.

Chirino, et al. Minimizing the immunogenicity of protein therapeutics. Drug Discovery Today. 2004; 9:82-90.

Chong, et al. Determination of Disulfide Bond Assignments and N-Glycosylation Sites of the Human Gastrointestinal Carcinoma Antigen GA733-2 (CO17-1A, EGP, KS1-4, KSA, and Ep-CAM). J. Biol. Chem. 2001; 276:5804-5813.

Chong, et al. Disulfide Bond Assignments of Secreted Frizzled-related Protein-1 Provide Insights about Frizzled Homology and Netrin Modules. J. Biol. Chem. 2002; 277:5134-5144.

Chou, et al. Prediction of Protein Conformation. Biochemistry. 1974; 13: 222-245.

Chowdhury, et al. Improving antibody affinity by mimicking somatic hypermutation in vitro. Nat Biotechnol. 1999; 17(6):568-72.

Christmann, et al. The cystine knot of a squash-type protease inhibitor as a structural scaffold for Escherichia coli cell surface display of conformationally constrained peptides. Protein Eng. 1999; 12:797-806.

Clark, et al. Long-acting growth hormones produced by conjugation with polyethylene glycol. J Biol Chem. 1996; 271(36):21969-77.

Clark, et al. Recombinant human growth hormone (GH)-binding protein enhances the growth-promoting activity of human GH in the rat. Endocrinology. 1996; 137(10):4308-15.

Cleland, et al. Emerging protein delivery methods. Current Opinion in Biotechnology. 2001; 12:212-219.

Coia, et al. Use of mutator cells as a means for increasing production levels of a recombinant antibody directed against Hepatitis B. Gene. 1997; 201: 203-9.

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

Conticello, et al. Mechanisms for evolving hypervariability: the case of conopeptides. Mol. Biol. Evol. 2001; 18:120-131.

(56) References Cited

OTHER PUBLICATIONS

Corisdeo, et al. Functional expression and display of an antibody Fab fragment in *Escherichia coli*: study of vector designs and culture conditions. Protein Expr Purif. 2004; 34(2):270-9.

Craik, et al. Plant cyclotides: A unique family of cyclic and knotted proteins that defines the cyclic cystine knot structural motif. J Mol Biol. 1999; 294: 1327-1336.

Crameri, et al. Improved Green Fluorescent Protein by Molecular Evolution Using DNA Shuffling. Nature Biotechnology. 1996; 14: 315-319.

Cull, et al. Screening for receptor ligands using large libraries of peptides linked to the C terminus of the lac repressor. Proc. Natl. Acad. Sci. USA. 1992; 89: 1865-1869.

Daley, et al. Structure and dynamics of a beta-helical antifreeze protein. Biochemistry. 2002; 41: 5515-25.

Daniel et al. Screening for potassium channel modulators by a high through-put 86-rubidium efflux assay in a 96-well microtiter plate. J. Pharmacol. Meth. 1991; 25:185-193.

Danner, et al. T7 phage display: a novel genetic selection system for cloning RNA-binding proteins from cDNA libraries. Proc Natl Acad Sci U S A. 2001; 98: 12954-9.

D'Aquino, et al. The magnitude of the backbone conformational entropy change in protein folding. Proteins. 1996; 25: 143-56.

Dattani, et al. An investigation into the lability of the bioactivity of human growth hormone using the ESTA bioassay. Horm Res. 1996; 46(2):64-73.

Dauplais, et al. On the convergent evolution of animal toxins. Conservation of a diad of functional residues in potassium channel-blocking toxins with unrelated structures. J Biol Chem. 1997; 272: 4302-9.

De Kruif, et al. Selection and application of human single chain Fv antibody fragments from a semi-synthetic phage antibody display library with designed CDR3 regions. J Mol Biol. 1995; 248: 97-105.

De Rosa, et al. Influence of the co-encapsulation of different non-ionic surfactants on the properties of PLGA insulin-loaded microspheres. J Control Release. 2000; 69(2):283-95.

De, et al. Crystal Structure of a disulfide-linked "trefoil" motif found in a large family of putative growth factors. PNAS 1994; 91:1084-1088.

Deckert, et al. Pharmacokinetics and microdistribution of polyethylene glycol-modified humanized A33 antibody targeting colon cancer xenografts. Int J Cancer. 2000; 87: 382-90.

Der Maur, et al. Direct in vivo screening of intrabody libraries constructed on a highly stable single-chain framework. J Biol Chem. 2002; 277(47):45075-85.

Desplancq, et al. Multimerization behaviour of single chain Fv variants of the tumour-binding antibody B72.3. Protein Eng. 1994; 7(8):1027-33.

Dhalluin, et al. Structural and biophysical characterization of the 40 kDa PEG-interferon-alpha2a and its individual positional isomers. Bioconjug Chem. 2005; 16: 504-17.

Di Lullo, et al. Mapping the ligand-binding sites and disease-associated mutations on the most abundant protein in the human, type I collagen. J Biol Chem. 2002; 277(6):4223-31.

Dietrich, et al.; ABC of oral bioavailability: transporters as gatekeepers in the gut. Gut. 2005; 52:1788-1795.

Dolezal, et al. ScFv multimers of the anti-neuraminidase antibody NC10: shortening of the linker in single-chain Fv fragment assembled in V(L) to V(H) orientation drives the formation of dimers, trimers, tetramers and higher molecular mass multimers. Protein Eng. 2000; 13(8):565-74.

Dooley, et al. Stabilization of antibody fragments in adverse environments. Biotechnol Appl Biochem. 1998; 28 ( Pt 1):77-83.

Doyle, et al. Crystal structures of a complexed and peptide-free membrane protein-binding domain: molecular basis of peptide recognition by PDZ. Cell. Jun. 28, 1996;85(7):1067-76.

Dufton. Classification of elapid snake neurotoxins and cytotoxins according to chain length: evolutionary implications. J. Mol. Evol. 1984; 20:128-134.

Dumoulin, et al. Single-domain antibody fragments with high conformational stability. Protein Sci. 2002; 11(3):500-15.

Dutton, et al. A New Level of Conotoxin Diversity, a Non-native Disulfide Bond Connectivity in -Conotoxin AuIB Reduces Structural Definition but Increases Biological Activity. J. Biol Chem. 2002; 277: 48849-48857.

Dyson, et al. Production of soluble mammalian proteins in *Escherichia coli*: identification of protein features that correlate with successful expression. BMC Biotechnol. 2004; 4:32.

Ellis, et al. Valid and invalid implementations of GOR secondary structure predictions. Comput Appl Biosci. Jun. 1994;10(3):341-8.

European search report dated Feb. 4, 2010 for Application No. 6804210.

European search report dated Mar. 26, 2009 for Application No. 7752636.6.

European search report dated Mar. 5, 2009 for Application No. 7752549.1.

Fajloun, et al. Maurotoxin Versus Pil/HsTx1 Scorpion Toxins. Toward New Insights in the Understanding of Their Distinct Disulfide Bridge Patterns J. Biol. Chem. 2000; 275:39394-402.

Felici, et al. Selection of antibody ligands from a large library of oligopeptides expressed on a multivalent exposition vector. J Mol Biol. 1991; 222: 301-310.

Fisher, et al. Genetic selection for protein solubility enabled by the folding quatliy control feature of the twin-arginin translocation pathway. Protein Sci. Mar. 2006;15(3):449-58.

Fitzgerald, et al. Interchangeability of Caenorhabditis elegans DSL proteins and intrinsic signalling activity of their extracellular domains in vivo Development. 1995; 121:4275-82.

Franz, et al. Percutaneous absorption on the relevance of in vitro data. J Invest Dermatol. 1975; 64(3):190-5.

Frenal, et al. Exploring structural features of the interaction between the scorpion toxinCnErg1 and ERG K+ channels. Proteins. 2004; 56: 367-375.

Gamez, et al. Development of pegylated forms of recombinant Rhodosporidium toruloides phenylalanine ammonia-lyase for the treatment of classical phenylketonuria. Mol Ther. 2005; 11: 986-9.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone.0010175.

GenBank: EIW63862.1. hypothetical protein TRAVEDRAFT_138159 [Trametes versicolor FP-101664 SS1]. Available at http://www.ncbi.nlm.nih.gov/protein/392570690?report=genbank&log$=protalign&blast_rank=1&RID=3ERS0M7501R. Accessed on Sep. 16, 2013.

Gilkes, et al. Domains in microbial beta-1, 4-glycanases: sequence conservation, function, and enzyme families. Microbiol Rev. 1991; 55: 303-15.

Gomez-Duarte, et al. Expression of fragment C of tetanus toxin fused to a carboxyl-terminal fragment of diphtheria toxin in *Salmonella typhi* CVD 908 vaccine strain. Vaccine. 1995; 13(16):1596-602.

Graff, et al. Theoretical analysis of antibody targeting of tumor spheroids: importance of dosage for penetration, and affinity for retention. Cancer Res. 2003; 63(6):1288-96.

Gray, et al. Peptide Toxins From Venomous Conus Snails. Annu Rev Biochem 1988; 57:665-700.

Greenwald, et al. Effective drug delivery by PEGylated drug conjugates. Adv Drug Deliv Rev. 2003; 55: 217-50.

Guncar, et al. Crystal structure of MHC class II-associated p41 Ii fragment bound to cathepsin L reveals the structural basis for differentiation between cathepsins L and S EMBO J 1999; 18:793-803.

Guo, et al. Crystal Structure of the Cysteine-rich Secretory Protein Stecrisp Reveals That the Cysteine-rich Domain Has a K+ Channel Inhibitor-like Fold. J Biol Chem. 2005; 280: 12405-12.

Gupta, et al. A classification of disulfide patterns and its relationship to protein structure and function. Protein Sci. 2004; 13: 2045-2058.

Gustafsson, et al. Codon bias and heterologous protein expression. Trends Biotechnol. 2004; 22: 346-53.

Hamers-Casterman, et al. Naturally occurring antibodies devoid of light chains. Nature. 1993; 363(6428):446-8.

Hammer. New methods to predict MHC-binding sequences within protein antigens. Curr Opin Immunol 1995; 7: 263-9.

(56) References Cited

OTHER PUBLICATIONS

Harris, et al. Effect of pegylation on pharmaceuticals. Nat Rev Drug Discov. 2003; 2: 214-21.
Henninghausen, et al. Mouse whey acidic protein is a novel member of the family of 'four-disulfide core' proteins. Nucleic Acids Res. 1982; 10:2677-2684.
Hermeling, et al. Structure-immunogenicty relationships of therapeutic proteins. Pharm. Res. 2004; 21: 897-903.
Hill, et al. Conotoxin TVIIA, a novel peptide from the venom of Conus tulipa 1. Isolation, characterization and chemical synthesis. Eur J Biochem. 2000; 267: 4642-8.
Hinds, et al. PEGylated insulin in PLGA microparticles. In vivo and in vitro analysis. J Control Release. Jun. 2, 2005;104(3):447-60.
Hirel, et al. Extent of N-terminal methionine excision from *Escherichia coli* proteins is governed by the side-chain length of the penultimate amino acid. Proc Natl Acad Sci U S A. 1989; 86(21):8247-51.
Hogg. Dislfide Bonds as Switches for Protein Function. Trends Biochem Sci, 2003; 28: 210-4.
Holevinsky et al. ATP-sensitive K+ channel opener acts as a potent Cl- channel inhibitor in vascular smooth muscle cells. J. Membrane Biology. 1994; 137:59-70.
Hopp, et al. Prediction of protein antigenic determinants from amino acid sequences. Proc Natl Acad Sci U S A 1981; 78, 3824, #3232.
Hsu, et al. Vaccination against gonadotropin-releasing hormone (GnRH) using toxin receptor-binding domain-conjugated GnRH repeats. Cancer Res. Jul. 15, 2000;60(14):3701-5.
Hudson, et al. High avidity scFv multimers; diabodies and triabodies. J Immunol Methods. 1999; 231(1-2):177-89.
Hugli. Structure and function of C3a anaphylatoxin. Curr Topics Microbiol Immunol. 1990; 153:181-208.
Huston, et al. Protein engineering of antibody binding sites: recovery of specific activity in an anti-digoxin single-chain Fv analogue produced in *Escherichia coli*. Proc Natl Acad Sci U S A. 1988; 85(16):5879-83.
International search report and written opinion dated Dec. 20, 2010 for PCT Application No. US10/02147.
International search report dated Jul. 12, 2011 for PCT Application No. US20/61590.
International search report dated Jan. 17, 2008 for PCT Application No. US2006/37713.
International search report dated Oct. 29, 2010 for PCT Application No. US10/37855.
International search report dated Dec. 26, 2007 for PCT Application No. US2007/05952.
International search report dated Mar. 16, 2009 for PCT Application No. US2008/09787.
International search report dated Apr. 20, 2010 for PCT Application No. US10-23106.
International search report dated Sep. 26, 2007 for PCT Application No. US2007/05857.
Iwasaki, et al. Solution structure of midkine, a new heparin-binding growth factor. Embo J. 1997; 16: 6936-6946.
Jackson, et al. The characterization of paclitaxel-loaded microspheres manufactured from blends of poly(lactic-co-glycolic acid) (PLGA) and low molecular weight diblock copolymers. Int J Pharm. Sep. 5, 2007;342(1-2):6-17.
Johansson, et al. Modifications increasing the efficacy of recombinant vaccines; marked increase in antibody titers with moderately repetitive variants of a therapeutic allergy vaccine. Vaccine. 2007; 25(9):1676-82.
Jonassen, et al. Finding flexible patterns in unaligned protein sequences. Protein Sci 1995; 4:1587-1595.
Jones, et al. Determination of Tumor Necrosis Factor Binding Protein Disulfide Structure: Deviation of the Fourth Domain Structure from the TNFR/NGFR Family Cysteine-Rich Region Signature Biochemistry. 1997; 36: 14914-23.
Jones, et al. Replacing the complementarity-determining regions in a human antibody with those from a mouse. Nature. 1986; 321(6069):522-5.
Jonsson, et al. Quantitative sequence-activity models (QSAM)—tools for sequence design. Nucleic Acids Res. 1993 ; 21: 733-9.
Jung, et al. Improving in vivo folding and stability of a single-chain Fv antibody fragment by loop grafting. Protein Eng. 1997; 10(8):959-66.
Kamikubo, et al. Disulfide bonding arrangements in active forms of the somatomedin B domain of human vitronectin. Biochemistry. 2004; 43: 6519-6534.
Kay, et al. An M13 phage library displaying random 38-amino-acid peptides as a source of novel sequences with affinity to selected targets. Gene. 1993; 128: 59-65.
Kelly, et al. Isolation of a Colon Tumor Specific Binding Peptide Using Phage Display Selection Neoplasia, 2003; 5: 437-44.
Khan, et al. Solubilization of recombinant ovine growth hormone with retention of native-like secondary structure and its refolding from the inclusion bodies of *Escherichia coli*. Biotechnol Prog. 1998; 14(5):722-8.
Kim, et al. Three-dimensional Solution Structure of the Calcium Channel Antagonist ω-Agatoxin IVA: Consensus Molecular Folding of Calcium Channel Blockers. J. Mol. Biol.1995; 250:659-671.
Kimble, et al. The LIN12/Notch signaling pathway and its regulation. Annu Rev Cell Dev Biol 1997; 13:333-361.
Kissel, et al. ABA-triblock copolymers from biodegradable polyester A-blocks and hydrophilic poly(ethylene oxide) B-blocks as a candidate for in situ forming hydrogel delivery systems for proteins. Adv Drug Deliv Rev. 2002; 54(1):99-134.
Kochendoerfer. Chemical and biological properties of polymer-modified proteins. Expert Opin Biol Ther. 2003; 3: 1253-61.
Kohn, et al. Random-coil behavior and the dimensions of chemically unfolded proteins. Proc Natl Acad Sci U S A. Aug. 24, 2004;101(34):12491-6.
Koide, et al. The fibronectin type III domain as a scaffold for novel binding proteins. J Mol Biol. 1998; 284: 1141-51.
Kornblatt, et al. Cross-linking of cytochrome oxidase subunits with difluorodinitrobenzene. Can J. Biochem. 1980; 58: 219-224.
Kortt, et al. Single-chain Fv fragments of anti-neuraminidase antibody NC10 containing five- and ten-residue linkers form dimers and with zero-residue linker a trimer. Protein Eng. 1997; 10(4):423-33.
Kou, et al. Preparation and characterization of recombinant protein ScFv(CD11c)-TRP2 for tumor therapy from inclusion bodies in *Escherichia coli*. Protein Expr Purif 2007; 52(1):131-8.
Kratzner, et al. Structure of Ecballium elaterium trypsin inhibitor II (EETI-II): a rigid molecular scaffold. Acta Crystallogr D Biol Crystallogr. Sep. 2005;61(Pt 9):1255-62.
Kristensen, et al. Proteolytic selection for protein folding using filamentous bacteriophages. Fold Des. 1998; 3: 321-8.
Kubetzko, et al. Protein PEGylation decreases observed target association rates via a dual blocking mechanism. Mol Pharmacol. 2005; 68: 1439-54.
Kwon, et al. Biodegradable triblock copolymer microspheres based on thermosensitive sol-gel transition. Pharm Res. 2004; 21(2):339-43.
Kyngas, et al. Unreliability of the Chou-Fasman parameters in predicting protein secondary structure. Protein Eng. May 1998;11(5):345-8.
Lane, et al. Influence of post-emulsification drying processes on the microencapsulation of human serum albumin. Int J Pharm. 2006; 307(1):16-22.
Lapatto, et al. X-ray structure of antistasin at 1.9 Å resolution and its modelled complex with blood coagulation factor Xa. Embo J. 1997; 16: 5151-61.
Lauber, et al. Homologous Proteins with Different Folds: The Three-dimensional Structures of Domains 1 and 6 of the Multiple Kazal-type Inhibitor LEKTI. J. Mol. Biol. 2003; 328:205-219.
Le Gall, et al. Di-, tri- and tetrameric single chain Fv antibody fragments against human CD19: effect of valency on cell binding. FEBS Lett. 1999; 453(1-2):164-8.
Lee, et al. A recombinant human G-CSF/GM-CSF fusion protein from *E. coli* showing colony stimulating activity on human bone marrow cells. Biotechnol Lett. 2003;25(3): 205-11.
Lee, VHL. Mucosal drug delivery. J Natl Cancer Inst Monogr. 2001; 29:41-44;.

(56) References Cited

OTHER PUBLICATIONS

Leong, et al. Adapting pharmacokinetic properties of a humanized anti-interleukin-8 antibody for therapeutic applications using site-specific pegylation. Cytokine. 2001; 16(3):106-19.

Leong, et al. Optimized expression and specific activity of IL-12 by directed molecular evolution. Proc. Natl. Acad. Sci. USA 2003; 100:1163-1168.

Leung, et al. A method for random mutagenesis of a defined DNA segment using a modified polymerase chain reaction. Technique. 1989; 1: 11-15.

Leung-Hagesteijn, et al. UNC-5, a transmembrane protein with immunoglobulin and thrombospondin type 1 domains, guides cell and pioneer axon migrations in C. elegans. Cell 1992; 71:289-99.

Levitt. A simplified representation of protein conformations for rapid simulation of protein folding. J Mol Biol 1976; 104, 59-107.

Levy, et al. Isolation of trans-acting genes that enhance soluble expression of scFv antibodies in the *E. coli* cytoplasm by lambda phage display. J Immunol Methods. 2007; 321(1-2):164-73.

Lin, et al. Metal-chelating affinity hydrogels for sustained protein release. J Biomed Mater Res A. 2007; 83(4):954-64.

Lirazan, et al. The Spasmodic Peptide Defines a New Conotoxin Superfamily. Biochemistry. 2000; 39: 1583-8.

Liu et al. The Human beta-Defensin-1 and alpha-Defensins Are Encoded by Adjacent Genes: Two Peptide Families with Differing Disulfide Topology Share a Common Ancestry. Genomics. 1997; 43:316-320.

Lowman, et al. Selecting high-affinity binding proteins by monovalent phage display. Biochemistry. 1991; 30: 10832-10838.

Maggio. Intravail™: highly effective intranasal delivery of peptide and protein drugs Expert Opinion in Drug Delivery 2006; 3: 529-539.

Maggio. A Renaissance in Peptide Therapeutics in Underway. Drug Delivery Reports. 2006; 23-26.

Maillere et al. Role of thiols in the presentation of a snake toxin to murine T cells. J. Immunol 1993; 150, 5270-5280.

Maillere, et al. Immunogenicity of a disulphide-containing neurotoxin: presentation to T-cells requires a reduction step. Toxicon, 1995; 33(4): 475-482.

Marshall, et al. Enhancing the activity of a beta-helical antifreeze protein by the engineered addition of coils. Biochemistry, 2004; 43: 11637-11646.

Martin, et al. Rational design of a CD4 mimic that inhibits HIV-1 entry and exposes cryptic neutralization epitopes. Nat. Biotechnol. 2003; 21: 71-76.

Martineau, et al. Expression of an antibody fragment at high levels in the bacterial cytoplasm. J Mol Biol. 1998; 280(1):117-27.

McDonald, et al. Significance of blood vessel leakiness in cancer. Cancer Res. 2002; 62: 5381-5.

McNulty, et al. High-resolution NMR structure of the chemically-synthesized melanocortin receptor binding domain AGRP(87-132) of the Agouti-Related Protein. Biochemistry. 2001; 40: 15520-7.

Meier, et al. Determination of a high-precision NMR structure of the minicollagen cysteine rich domain from Hydra and characterization of its disulfide bond formation. FEBS Lett. 2004; 569: 112-6.

Miljanich. Ziconotide: neuronal calcium channel blocker for treating severe chronic pain. Curr. Med. Chem. 2004; 23: 3029.

Misenheimer, et al. Biophysical Characterization of the Signature Domains of Thrombospondin-4 and Thrombospondin-2. J. Biol. Chem. 2005; 280:41229-41235.

Misenheimer, et al. Disulfide Connectivity of Recombinant C-terminal Region of Human Thrombospondin 2 J. Biol. Chem. 2001; 276:45882-7.

Mitraki, et al. Protein Folding Intermediates and Inclusion Body Formation. Bio/Technology. 1989; 7:690-697.

Mogk, et al. Mechanisms of protein folding: molecular chaperones and their application in biotechnology. Chembiochem. Sep. 2, 2002;3(9):807-14.

Mrsny, et al. Bacterial toxins as tools for mucosal vaccination. Drug Discovery Today. 2002; 4:247-258.

Murtuza, et al. Transplantation of skeletal myoblasts secreting an IL-1 inhibitor modulates adverse remodeling in infarcted murine myocardium. Proc Natl Acad Sci U S A. Mar. 23, 2004;101(12):4216-21.

Narmoneva, et al. Self-assembling short oligopeptides and the promotion of angiogenesis. Biomaterials. 2005; 26:4837-4846.

NCBI Reference Sequence: WP_005158338.1. Serine phosphatase RsbU, regulator of sigma subunit [Amycolatopsis azurea]. Available at http://www.ncbi.nlm.nih.gov/protein/491300334?report=genbank&log$=protalign&blast_rank=1&RID=3ERS0M7501R. Accessed on Sep. 16, 2013.

NCBI Reference Sequence: XP_003746909.1. Predicted: electron transfer flavoprotein subunit alpha, mitochondrial-like [Metaseiulus occidentalis]. Available at http://www.ncbi.nlm.nih.gov/protein/391345263?report=genbank&log$=protalign&blast_rank=1&RID=3ERS0M7501R. Accessed on Sep. 16, 2013.

Nielsen, et al. Di-/Tri-peptide transporters as drug delivery targets: Regulation of transport under physiological and patho-physiological conditions. Current Drug Targets. 2003; 4:373-388.

Nielsen, et al. Solution Structure of μ-Conotoxin PIIIA, a Preferential Inhibitor of Persistent Tetrodotoxin-sensitive Sodium Channels. J. Biol. Chem 2002; 277: 27247-27255.

Nord, et al. Binding proteins selected from combinatorial libraries of an α-helical bacterial receptor domain. Nat Biotechnol, 1997; 15: 772-777.

O'Connell, et al. Phage versus phagemid libraries for generation of human monoclonal antibodies. J Mol Biol. 2002; 321: 49-56.

Ofir, et al. Versatile protein microarray based on carbohydrate-binding modules. Proteomics. 2005; 5(7):1806-14.

Okten, et al. Myosin VI walks hand-over-hand along actin. Nat Struct Mol Biol. 2004; 11(9):884-7.

O'Leary, et al. Solution Structure and Dynamics of a Prototypical Chordin-like Cysteine-rich Repeat (von Willebrand Factor Type C Module) from Collagen IIA. J Biol Chem. 2004; 279: 53857-66.

Padiolleau-Lefevre, et al. Expression and detection strategies for an scFv fragment retaining the same high affinity than Fab and whole antibody: Implications for therapeutic use in prion diseases. Mol Immunol 2007; 44(8):1888-96.

Pallaghy, et al. A common structural motif incorporating a cystine knot and a triple-stranded beta-sheet in toxic and inhibitory polypeptides. Protein Sci 1994; 3:1833-1839.

Pallaghy, et al. Three-dimensional Structure in Solution of the Calcium Channel Blocker ω-Conotoxin. J Mol Biol 1993; 234:405-420.

Pan, et al. Structure and expression of fibulin-2, a novel extracellular matrix protein with multiple EGF-like repeats and consensus motifs for calcium binding.. J. Cell. Biol. 1993; 123: 1269-127.

Panda. Bioprocessing of therapeutic proteins from the inclusion bodies of *Escherichia coli*. Adv Biochem Eng Biotechnol. 2003; 85:43-93.

Patra, et al. Optimization of inclusion body solubilization and renaturation of recombinant human growth hormone from *Escherichia coli*. Protein Expr Punt'. 2000; 18(2):182-92.

Pelegrini, et al. Plant gamma-thionins. novel insights on the mechanism of action of a multi-functional class of defense proteins. Int J Biochem Cell Biol. 2005; 37: 2239-53.

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Petersen, et al. The dual nature of human extracellular superoxide dismutase: one sequence and two structures. Proc. Natl. Acad. Sci. USA 2003; 100:13875-80.

Pi, et al. Analysis of expressed sequence tags from the venom ducts of Conus striatus: focusing on the expression profile of conotoxins. Biochimie 2006; 88(2):131-40.

Pimanda, et al. The von Willebrand factor-reducing activity of thrombospondin-1 is located in the calcium-binding/C-terminal sequence and requires a free thiol at position 974. Blood. 2002; 100: 2832-2838.

Pokidysheva, et al. The Structure of the Cys-rich Terminal Domain of Hydra Minicollagen, Which Is Involved in Disulfide Networks of the Nematocyst Wall. J Biol Chem. 2004; 279: 30395-401.

(56) References Cited

OTHER PUBLICATIONS

Popkov, et al. Isolation of human prostate cancer cell reactive antibodies using phage display technology. J. Immunol Methods. 2004; 291:137-151.
Qi, et al. Structural Features and Molecular Evolution of Bowman-Birk Protease Inhibitors and Their Potential Application (283-292). Act Biochim Biophys Sin. (Shanghai) 2005; 37: 283-292.
Rao, et al. Molecular and Biotechnological Aspects of Microbial Proteases. Microbiol Mol Biol Rev. 1998; 62(3): 597-635.
Rasmussen, et al. Tumor cell-targeting by phage-displayed peptides. Cancer Gene Ther. 2002; 9: 606-12.
Rawlings, et al. Evolutionary families of peptidase inhibitors. Biochem J. 2004; 378: 705-16.
Rebay, et al. Specific EGF repeats of Notch mediate interactions with Delta and serrate: Implications for notch as a multifunctional receptor. Cell 1991; 67:687-699.
Roberge, et al. Construction and optimization of a CC49-based scFv-beta-lactamase fusion protein for ADEPT. Protein Eng Des Sel. 2006; 19(4):141-5.
Rosenfeld, et al. Biochemical, Biophysical, and Pharmacological Characterization of Bacterially Expressed Human Agouti-Related Protein. Biochemistry. 1998; 37: 16041-52.
Roussel, et al. Complexation of Two Proteic Insect Inhibitors to the Active Site of Chymotrypsin Suggests Decoupled Roles for Binding and Selectivity. J Biol Chem. 2001; 276: 38893-8.
Sahdev, et al. Production of active eukaryotic proteins through bacterial expression systems: a review of the existing biotechnology strategies. Mol Cell Biochem. Jan. 2008;307(1-2):249-64.
Salloum, et al. Anakinra in experimental acute myocardial infarction—does dosage or duration of treatment matter? Cardiovasc Drugs Ther. Apr. 2009;23(2):129-35.
Schellenberger, et al. A recombinant polypeptide extends the in vivo half-life of peptides and proteins in a tunable manner. Nat Biotechnol. Dec. 2009;27(12):1186-90.
Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.
Scholle, et al. Efficient construction of a large collection of phage-displayed combinatorial peptide libraries. Comb. Chem. & HTP Screening 2005; 8:545-551.
Schultz-Cherry, et al. Regulation of Transforming Growth Factor-beta Activation by Discrete Sequences of Thrombospondin. J. Biol. Chem. 1995; 270:7304-7310.
Schultz-Cherry, et al. The type 1 repeats of thrombospondin 1 activate latent transforming growth factor-beta. J. Biol. Chem. 1994; 269:26783-8.
Shen, et al. A Type I Peritrophic Matrix Protein from the Malaria Vector Anopheles gambiae Binds to Chitin. Cloning, Expression, and Characterization. J Biol Chem. 1998; 273: 17665-70.
Sidhu, et al. Phage display for selection of novel binding peptides. Methods Enzymol. 2000; 328: 333-63.
Silverman, et al. Multivalent avimer proteins evolved by exon shuffling of a family of human receptor domains. Nat Biotechnol 2005; 23:1556-1561.
Simonet, et al. Structural and functional properties of a novel serine protease inhibiting peptide family in arthropods. Comp Biochem Physiol B Biochem Mol Biol. 2002; 132: 247-55.
Singh, et al. ProPred: Prediction of HLA-DR binding sites. Bioinformatics. 2001; 17: 1236-1237.
Skinner, et al. Purification and characterization of two classes of neurotoxins from the funnel web spider, Agelenopsis aperta. J. Biol. Chem. 1989; 264:2150-2155.
Smith, et al. Phage Display. Chem Rev. 1997; 97: 391-410.
Smith, et al. Single-step purification of polypeptides expressed in Escherichia coli as fusions with glutathione S-transferase. Gene. 1988; 67(1):31-40.
So, et al. Contribution of conformational stability of hen lysozyme to induction of type 2 T-helper immune responses. Immunology. 2001; 104: 259-268.

Srivastava, et al. Application of self-assembled ultra-thin film coatings to stabilize macromolecule encapsulation in alginate microspheres. J Microencapsul. 2005; 22(4):397-411.
Stamos, et al. Crystal structure of the HGF beta-chain in complex with the Sema domain of the Met receptor. Embo J. 2004; 23: 2325-35.
Steipe, et al. Sequence statistics reliably predict stabilizing mutations in a protein domain. J Mol Biol. 1994; 240(3):188-92.
Stemmer, et al. Single-step assembly of a gene and entire plasmid from large numbers of oligodeoxyribonucleotides. Gene 1995; 164(1):49-53.
Stemmer, W. Rapid evolution of a protein in vitro by DNA shuffling. Nature. 1994; 370: 389-391.
Stickler, et al. Human population-based identification of CD4(+) T-cell peptide epitope determinants. J Immunol Methods. 2003; 281: 95-108.
Stites, et al. Empirical evaluation of the influence of side chains on the conformational entropy of the polypeptide backbone. Proteins. 1995; 22: 132-140.
Stoll, et al. A mechanistic analysis of carrier-mediated oral delivery of protein therapeutics. J Control Release. 2000; 64: 217-28.
Sturniolo, et al. Generation of tissue-specific and promiscuous HLA ligand databases using DNA microarrays and virtual HLA class II matrices. Natural Biotechnol. 1999; 17: 555-561.
Suetake, et al. Chitin-binding Proteins in Invertebrates and Plants Comprise a Common Chitin-binding Structural Motif. J Biol Chem. 2000; 275: 17929-32.
Suetake, et al. Production and characterization of recombinant tachycitin, the Cys-rich chitin-binding protein. Protein Eng. 2002; 15: 763-9.
Summers, et al. Baculovirus structural polypeptides. Virology. 1978; 84(2):390-402.
Takahashi, et al. Solution structure of hanatoxin1, a gating modifier of voltage-dependent K+ channels: common surface features of gating modifier toxins. J Mol Biol, 2000; 297: 771-80.
Takenobu, et al. Development of p53 protein transduction therapy using membrane-permeable peptides and the application to oral cancer cells. Mol Cancer Ther. 2002; 1: 1043-9.
Tam, et al. A biomimetic strategy in the synthesis and fragmentation of cyclic protein. Protein Sci. 1998; 7:1583.
Tavladoraki, et al. A single-chain antibody fragment is functionally expressed in the cytoplasm of both *Escherichia coli* and transgenic plants. Eur J Biochem. 1999; 262(2):617-24.
Tax, et al. Sequence of *C. elegans lag*-2 reveals a cell-signalling domain shared with *Delta* and *Serrate* of *Drosophila*. Nature 1994; 368: 150-154.
Terpe, K. Overview of tag protein fusions: from molecular and biochemical fundamentals to commercial systems. Appl Microbiol Biotechnol. Jan. 2003;60(5):523-33.
Thai, et al. Antigen stability controls antigen presentation. J. Biol. Chem. 2004; 279: 50257-50266.
Tolkatchev, et al. Design and Solution Structure of a Well-Folded Stack of Two beta-Hairpins Based on the Amino-Terminal Fragment of Human Granulin A. Biochemistry, 2000; 39: 2878-86.
Torres, et al. Solution structure of a defensin-like peptide from platypus venom. Biochem J. 1999; 341 ( Pt 3): 785-794.
Tur, et al. A novel approach for immunization, screening and characterization of selected scFv libraries using membrane fractions of tumor cells. Int J Mol Med. 2003; 11: 523-7.
Uversky, et al. Why are "natively unfolded" proteins unstructured under physiologic conditions? Proteins. Nov. 15, 2000;41(3):415-27.
Valente, et al. Optimization of the primary recovery of human interferon alpha2b from *Escherichia coli* inclusion bodies. Protein Expr Purif 2006; 45(1):226-34.
Van Den Hooven, et al. Disulfide Bond Structure of the AVR9 Elicitor of the Fungal Tomato Pathogen *Cladosporium fulvum*: Evidence for a Cystine Knot. Biochemistry 2001; 40:3458-3466.
Van Vlijmen, et al. A novel database of disulfide patterns and its application to the discovery of distantly related homologs. J Mol. Biol. 2004; 335:1083-1092.
Vanhercke, et al. Reducing mutational bias in random protein libraries. Anal Biochem. 2005; 339: 9-14.

(56) References Cited

OTHER PUBLICATIONS

Vardar, et al. Nuclear Magnetic Resonance Structure of a Prototype Lin12-Notch Repeat Module from Human Notch1. Biochemistry 2003; 42:7061-7067.
Venkatachalam, et al. Conformation of polypeptide chains. Annu Rev Biochem. 1969; 38: 45-82.
Ventura. Sequence determinants of protein aggregation: tools to increase protein solubility. Microb Cell Fact. 2005; 4(1):11.
Vestergaard-Bogind, et al. Single-file diffusion through the $Ca^{2+}$-activated $K^+$ channel of human red cells. J. Membrane Biol. 1985; 88:67-75.
Voisey, et al. Agouti: from Mouse to Man, from Skin to Fat Pigment Cell Res. 2002; 15: 10-18.
Vranken, et al. A 30 residue fragment of the carp granulin 1 protein folds into a stack of two β hairpins similar to that found in the native protein J Pept Res. 1999; 53: 590-7.
Walker, et al. Using protein-based motifs to stabilize peptides. J Pept Res. Nov. 2003;62(5):214-26.
Wang, et al. Structure-function studies of omega-atracotoxin, a potent antagonist of insect voltage-gated calcium channels. Eur J Biochem. 1999; 264: 488-494.
Ward, et al. Binding activities of a repertoire of single immunoglobulin variable domains secreted from *Escherichia coli*. Nature. 1989; 341(6242):544-6.
Watters, et al. An optimized method for cell-based phage display panning. Immunotechnology. 1997; 3: 21-29.
Weimer, et al. Prolonged in-vivo half-life of factor VIIa by fusion to albumin. Thromb Haemost. Apr. 2008;99(4):659-67. (Abstract only).
Weiss, et al. A cooperative model for receptor recognition and cell adhesion: evidence from the molecular packing in the 1.6-A crystal structure of the pheromone Er-1 from the ciliated protozoan Euplotes raikovi. Proc Natl Acad Sci U SA 1995; , 92: 10172-6.
Wentzel, et al. Sequence requirements of the GPNG beta-turn of the Ecballium elaterium trypsin inhibitor II explored by combinatorial library screening. J Biol Chem. Jul. 23, 1999;274(30):21037-43.
Werle, et al. The potential of cystine-knot microproteins as novel pharmacophoric scaffolds in oral peptide drug delivery. J. Drug Targeting 2006; 14:137-146.
Werther, et al. Humanization of an anti-lymphocyte function-associated antigen (LFA)-1 monoclonal antibody and reengineering of the humanized antibody for binding to rhesus LFA-1. J Immunol 1996; 157(11):4986-95.
Whitlow, et al. Multivalent Fvs: characterization of single-chain Fv oligomers and preparation of a bispecific Fv. Protein Eng. 1994; 7(8):1017-26.
Winter, et al. Humanized antibodies. Trends Pharmacol Sci. May 1993;14(5):139-43.
Wittrup. Protein engineering by cell-surface display. Curr Opin Biotechnol. 2001; 12: 395-9.
Worn, et al. Correlation between in vitro stability and in vivo performance of anti-GCN4 intrabodies as cytoplasmic inhibitors. J Biol Chem. 2000; 275(4):2795-803.
Worn, et al. Stability engineering of antibody single-chain Fv fragments. J Mol Biol. 2001; 305(5):989-1010.
Wrammert, et al. Rapid cloning of high-affinity human monoclonal antibodies against influenza virus. Nature. 2008; 453(7195):667-71.
Wright, et al. Intrinsically unstructured proteins: re-assessing the protein structure-function paradigm. J Mol Biol. Oct. 22, 1999;293(2):321-31.
Xiong, et al. A Novel Adaptation of the Integrin PSI Domain Revealed from Its Crystal Structure. J Biol Chem. 2004; 279: 40252-4.
Xu, et al. Solution Structure of BmP02, a New Potassium Channel Blocker from the Venom of the Chinese Scorpion *Buthus martensi* Karsch Biochemistry 2000; 39:13669-13675.
Yamazaki, et al. A possible physiological function and the tertiary structure of a 4-kDa peptide in legumes. Eur J Biochem. 2003; 270: 1269-1276.
Yang, et al. CDR walking mutagenesis for the affinity maturation of a potent human anti-HIV-1 antibody into the picomolar range. J Mol Biol. 1995; 254:392-403.
Yang, et al. Intestinal Peptide transport systems and oral drug availability. Pharmaceutical Research. 1999; 16: 1331-1343.
Yang, et al. Tailoring structure-function and pharmacokinetic properties of single-chain Fv proteins by site-specific PEGylation. Protein Eng. 2003; 16: 761-70.
Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.
Yuan, et al. Solution structure of the transforming growth factor beta-binding protein-like module, a domain associated with matrix fibrils. Embo J. 1997; 16: 6659-66.
Zaveckas, et al. Effect of surface histidine mutations and their number on the partitioning and refolding of recombinant human granulocyte-colony stimulating factor (Cys17Ser) in aqueous two-phase systems containing chelated metal ions. J Chromatogr B Analyt Technol Biomed Life Sci. 2007; 852(1-2):409-19.
Zhu, et al. Molecular cloning and sequencing of two 'short chain' and two 'long chain' K(+) channel-blocking peptides from the Chinese scorpion Buthus martensii Karsch. FEBS Lett 1999; 457:509-514.
Chou; et al., "Prediction of the Secondary Structure of Proteins from Their Amino Acid Sequence, from Advances in Enzymology vol. 47, John Wiley and Sons. Published 1978, p. 60.".
Office action dated Aug. 23, 2012 for U.S. Appl. No. 12/848,984.
Prinz, et al. The Role of the Thioredoxin and Glutaredoxin Pathways in Reducing Protein Disulfide Bonds in the *Escherichia coli* Cytoplasm. J Biol Chem. 1997; 272(25):15661-7.
Schulz, et al. Potential of NIR-FT-Raman spectroscopy in natural carotenoid analysis. Biopolymers. Mar. 2005;77 (4):212-21.
Voet; et al., "Biochemistry (3rd Ed.). John Wiley and Sons. Published 2004, p. 230.".

```
LCW0569  ATGGCTNNNNNNGCTGGCTCTCCAACCTCCACTGAGGAAGGT
          M   A  X  X   A  G  S  P  T  S  T  E  E
LCW0570  ATGGCTNNNNNNGAAAGCGCAACCCCTGAGTCCGGTCCAGGT
          M   A  X  X   E  S  A  T  P  E  S  G  P
LCW0571  ATGGCTNNNNNNACTCCGTCTGGTGCTACCGGTTCCCCAGGT
          M   A  X  X   T  P  S  G  A  T  G  S  P
```

X = APST,         GS       or    GE
TCAG/C/TCAG, AG/G/TC  or  G/AG/AG
Diversity:  16           4              4

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 9

A.
B.
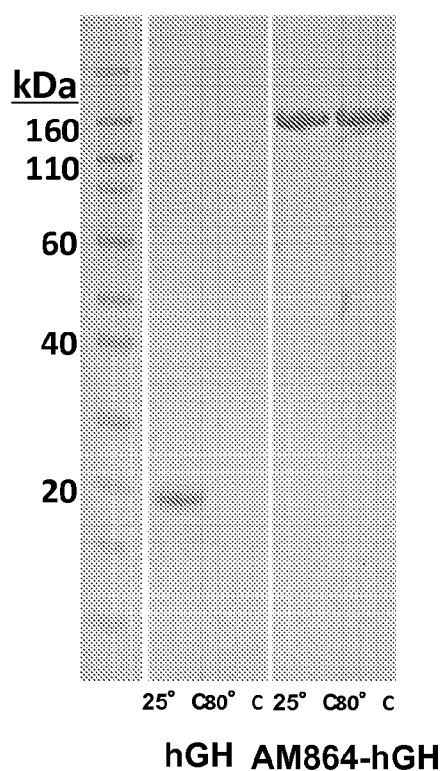
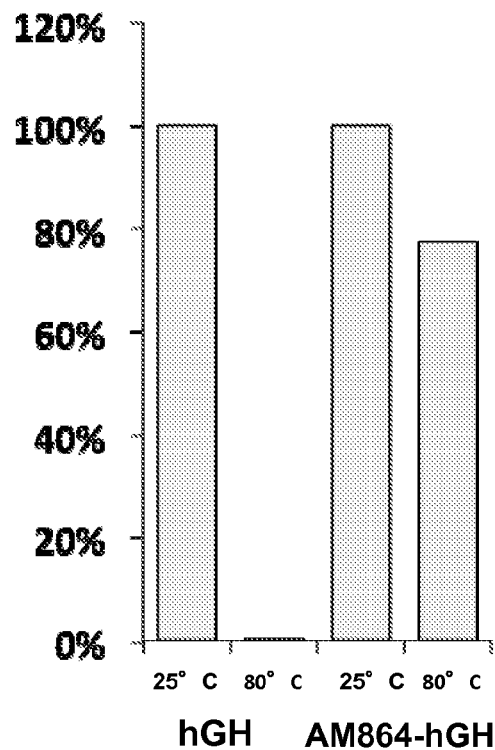
FIG. 29

A.
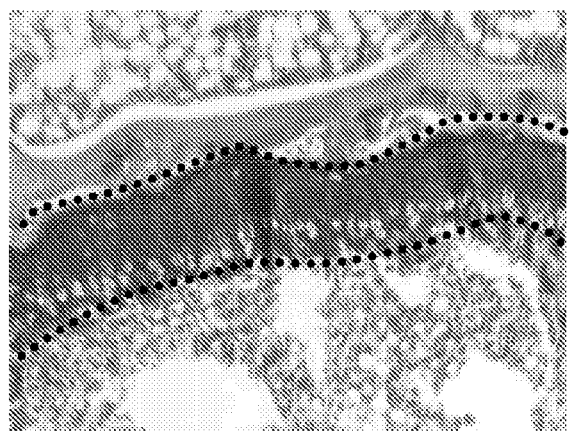
B.
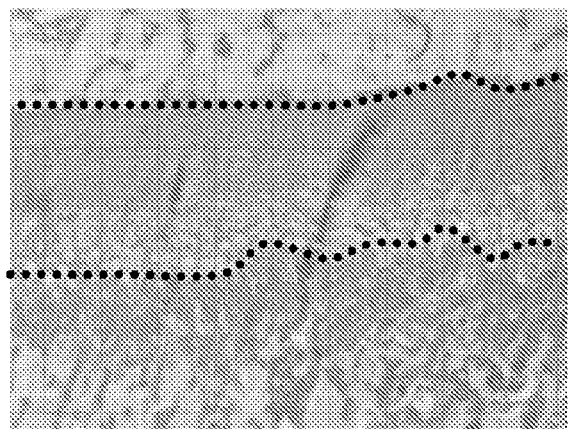
C.
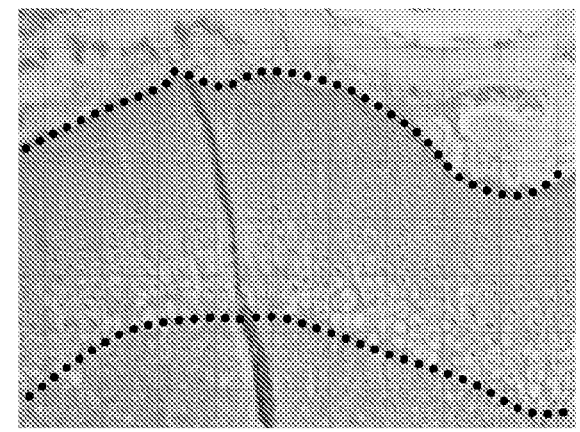
FIG. 35

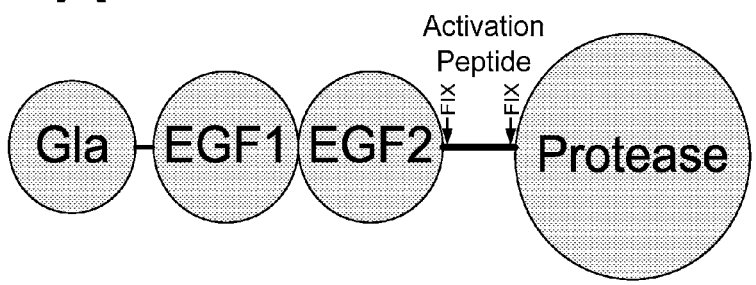
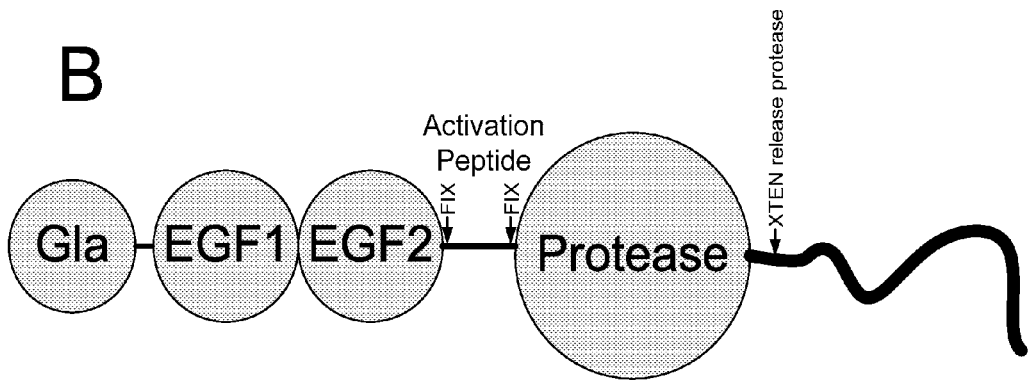
FIG. 36

MQRVNMIMAESPGLITICLLGYLLSAECTVFLDHENANKILNRPKRYNSGKLEEFVQGNLERECMEEKCS
FEEAREVFENTERTTEFWKQYVDGDQCESNPCLNGGSCKDDINSYECWCPFGFEGKNCELDVTCNIKN
GRCEQFCKNSADNKVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHCVETGVKIT
VVAGEHNIEETEHTEQKRNVIRIIPHHNYNAAINKYNHDIALLELDEPLVLNSYVTPICIADKEYTNIFLKFGS
GYVSGWGRVFHKGRSALVLQYLRVPLVDRATCLRSTKFTIYNNMFCAGFHEGGRDSCQGDSGGPHVT
EVEGTSFLTGIISWGEECAMKGKYGIYTKVSRYVNWIKEKTKLTGGKLTRVVGGGGGSPGASPGTSST
GSPGSSPSASTGTGPGSSPSASTGTGPGTPGSGTASSSPGSSTPSGATGSPGSNPSASTGTGPGASP
GTSSTGSPGTPGSGTASSSPGSSTPSGATGSPGTPGSGTASSSPGASPGTSSTGSPGASPGTSSTGS
PGTPGSGTASSSPGSSTPSGATGSPGASPGTSSTGSPGTPGSGTASSSPGSSTPSGATGSPGSNPSA
STGTGPGSSPSASTGTGPGSSTPSGATGSPGSSTPSGATGSPGASPGTSSTGSPGASPGTSSTGSPG
ASPGTSSTGSPGTPGSGTASSSPGASPGTSSTGSPGASPGTSSTGSPGASPGTSSTGSPGSSPSAST
GTGPGTPGSGTASSSPGASPGTSSTGSPGASPGTSSTGSPGASPGTSSTGSPGSSTPSGATGSPGSS
TPSGATGSPGASPGTSSTGSPGTPGSGTASSSPGSSTPSGATGSPGSSTPSGATGSPGSSTPSGATG
SPGSSPSASTGTGPGASPGTSSTGSPGASPGTSSTGSPGTPGSGTASSSPGASPGTSSTGSPGASPG
TSSTGSPGASPGTSSTGSPGASPGTSSTGSPGTPGSGTASSSPGSSTPSGATGSPGTPGSGTASSSP
GSSTPSGATGSPGTPGSGTASSSPGSSTPSGATGSPGSSTPSGATGSPGSSPSASTGTGPGSSPSAS
TGTGPGASPGTSSTGSPGTPGSGTASSSPGSSTPSGATGSPGSSPSASTGTGPGSSPSASTGTGPGA
SPGTSSTGSPGASPGTSSTGSPGSSTPSGATGSPGSSPSASTGTGPGASPGTSSTGSPGSSPSASTG
TGPGTPGSGTASSSPGSSTPSGATGSPGSSTPSGATGSPGASPGTSSTGSP

↓ Proteolytic Cleavage to Active FIXa Yields:

1. MQRVNMIMAESPGLITICLLGYLLSAECTVFLDHENANKILNRPKRYNSGKLEEFVQGNLE
   RECMEEKCSFEEAREVFENTERTTEFWKQYVDGDQCESNPCLNGGSCKDDINSYECWC
   PFGFEGKNCELDVTCNIKNGRCEQFCKNSADNKVVCSCTEGYRLAENQKSCEPAVPFPC
   GRVSVSQTSKLTR

2. AETVFPDVDYVNSTEAETILDNITQSTQSFNDFTR

3. VVGGEDAKPGQFPWQVVLNGKVDAFCGGSIVNEKWIVTAAHCVETGVKITVVAGEHNIEET
   EHTEQKRNVIRIIPHHNYNAAINKYNHDIALLELDEPLVLNSYVTPICIADKEYTNIFLKFGSGY
   VSGWGRVFHKGRSALVLQYLRVPLVDRATCLRSTKFTIYNNMFCAGFHEGGRDSCQGDS
   GGPHVTEVEGTSFLTGIISWGEECAMKGKYGIYTKVSRYVNWIKEKTKLTGGKLTR

4. VVGGGGGGSPGASPGTSSTGSPGSSPSASTGTGPGSSPSASTGTGPGTPGSGTASSSPG
   SSTPSGATGSPGSNPSASTGTGPGASPGTSSTGSPGTPGSGTASSSPGSSTPSGATGSPG
   TPGSGTASSSPGASPGTSSTGSPGASPGTSSTGSPGTPGSGTASSSPGSSTPSGATGSPG
   ASPGTSSTGSPGTPGSGTASSSPGSSTPSGATGSPGSNPSASTGTGPGSSPSASTGTGPG
   SSTPSGATGSPGSSTPSGATGSPGASPGTSSTGSPGASPGTSSTGSPGASPGTSSTGSPG
   TPGSGTASSSPGASPGTSSTGSPGASPGTSSTGSPGASPGTSSTGSPGSSPSASTGTGPG
   TPGSGTASSSPGASPGTSSTGSPGASPGTSSTGSPGASPGTSSTGSPGSSTPSGATGSPG
   SSTPSGATGSPGASPGTSSTGSPGTPGSGTASSSPGSSTPSGATGSPGSSTPSGATGSPG
   SSTPSGATGSPGSSPSASTGTGPGASPGTSSTGSPGASPGTSSTGSPGTPGSGTASSSPG
   ASPGTSSTGSPGASPGTSSTGSPGASPGTSSTGSPGASPGTSSTGSPGTPGSGTASSSPG
   SSTPSGATGSPGTPGSGTASSSPGSSTPSGATGSPGTPGSGTASSSPGSSTPSGATGSPG
   SSTPSGATGSPGSSPSASTGTGPGSSPSASTGTGPGASPGTSSTGSPGTPGSGTASSSPG
   SSTPSGATGSPGSSPSASTGTGPGSSPSASTGTGPGASPGTSSTGSPGASPGTSSTGSPG
   SSTPSGATGSPGSSPSASTGTGPGASPGTSSTGSPGSSPSASTGTGPGTPGSGTASSSPG
   SSTPSGATGSPGSSTPSGATGSPGASPGTSSTGSP

FIG. 44

EXTENDED RECOMBINANT POLYPEPTIDES AND COMPOSITIONS COMPRISING SAME

CROSS-REFERENCE TO RELATED APPLICATIONS

This application is a Continuation Application which claims the priority benefit of U.S. application Ser. No. 12/699,761, filed Feb. 3, 2010; which claims the priority benefit of U.S. Provisional Application Ser. Nos. 61/149,669 filed on Feb. 3, 2009; 61/268,193, filed Jun. 8, 2009; 61/185,112, filed Jun. 8, 2009; 61/236,493, filed Aug. 24, 2009; 61/236,836, filed Aug. 25, 2009; 61/243,707, filed Sep. 18, 2009; 61/245,490, filed Sep. 24, 2009; 61/280,955, filed Nov. 10, 2009; 61/280,956, filed Nov. 10, 2009; and 61/281,109, filed Nov. 12, 2009, which are hereby incorporated herein by reference in their entirety.

STATEMENT REGARDING FEDERALLY SPONSORED RESEARCH

This invention was made with government support under SBIR grant 2R44GM079873-02 awarded by the National Institutes of Health. The government has certain rights in the invention.

STATEMENT ACCORDING TO 37 C.F.R. §1.52(e)(5)-SEQUENCE LISTING

The specification further incorporates by reference the Sequence Listing submitted as a text file via EFS on Jun. 19, 2014. Pursuant to 37 C.F.R. §1.52(e)(5), the Sequence Listing text file, identified as 32808720.txt, is 7,133,717 bytes and was created on Feb. 8, 2010. The Sequence Listing, electronically filed via EFS, does not extend beyond the scope of the specification and thus does not contain new matter.

BACKGROUND OF THE INVENTION

Biologically active proteins including those as therapeutics are typically labile molecules exhibiting short shelf-lives, particularly when formulated in aqueous solutions. In addition, many biologically active peptides and proteins have limited solubility, or become aggregated during recombinant productions, requiring complex solubilization and refolding procedures. Various chemical polymers can be attached to such proteins to modify their properties. Of particular interest are hydrophilic polymers that have flexible conformations and are well hydrated in aqueous solutions. A frequently used polymer is polyethylene glycol (PEG). These polymers tend to have large hydrodynamic radii relative to their molecular weight (Kubetzko, S., et al. (2005) Mol Pharmacol, 68: 1439-54), and can result in enhanced pharmacokinetic properties. Depending on the points of attachment, the polymers tend to have limited interactions with the protein that they have been attached to such that the polymer-modified protein retains its relevant functions. However, the chemical conjugation of polymers to proteins requires complex multi-step processes. Typically, the protein component needs to be produced and purified prior to the chemical conjugation step. In addition, the conjugation step can result in the formation of heterogeneous product mixtures that need to be separated, leading to significant product loss. Alternatively, such mixtures can be used as the final pharmaceutical product, but are difficult to standardize. Some examples are currently marketed PEGylated Interferon-alpha products that are used as mixtures (Wang, B. L., et al. (1998) J Submicrosc Cytol Pathol, 30: 503-9; Dhalluin, C., et al. (2005) Bioconjug Chem, 16: 504-17). Such mixtures are difficult to reproducibly manufacture and characterize as they contain isomers with reduced or no therapeutic activity.

Albumin and immunoglobulin fragments such as Fc regions have been used to conjugate other biologically active proteins, with unpredictable outcomes with respect to increases in half-life or immunogenicity. Unfortunately, the Fc domain does not fold efficiently during recombinant expression and tends to form insoluble precipitates known as inclusion bodies. These inclusion bodies must be solubilized and functional protein must be renatured. This is a time-consuming, inefficient, and expensive process that requires additional manufacturing steps and often complex purification procedures.

Thus, there remains a significant need for compositions and methods that would improve the biological, pharmacological, safety, and/or pharmaceutical properties of a biologically active protein.

SUMMARY OF THE INVENTION

The present disclosure is directed to compositions and methods that can be useful for enhancing the biological, pharmaceutical, safety and/or therapeutic properties of biologically active proteins. The compositions and methods are particularly useful for enhancing the pharmacokinetic properties, such as half-life, and increasing the time spent within the therapeutic window of a biologically active protein, as well as simplifying the production process and pharmaceutical properties, such as solubility, of such a biologically active protein.

In part, the present disclosure is directed to pharmaceutical compositions comprising fusion proteins and the uses thereof for treating diseases, disorders or conditions. The particular disease to be treated will depend on the choice of the biologically active proteins. In some embodiments, the compositions and methods are useful for treating metabolic and cardiovascular diseases (including but not limited to glucose- or insulin-related diseases), coagulation and bleeding disorders, and growth-hormone related disorders.

In one aspect, the present invention provides compositions of extended recombinant polypeptides (XTENs), that when linked to a biologically active protein enhances the pharmacokinetic properties, and/or increases the solubility and stability of the resulting fusion protein, while retaining or enhancing overall biologic and/or therapeutic activity of the biologically active protein. Such compositions may have utility to treat certain diseases, disorders or conditions, as described herein. The resulting fusion protein can exhibit a better safety profile and permit less frequent dosing, which in turn can lead to better patient compliance. The present invention also provides polynucleotides encoding the XTEN and the fusion proteins of biologically active proteins linked with XTEN, as well as polynucleotides complementary to polynucleotides that encode the XTEN and the fusion proteins of biologically active proteins linked with XTEN.

In another aspect, the present invention provides compositions of extended recombinant polypeptides (XTEN) that are useful as fusion partners that can be linked to biologically active proteins (BPs), resulting in monomeric BPXTEN fusion proteins.

In one embodiment, the invention provides an isolated extended recombinant polypeptide (XTEN) comprising greater than about 400 to about 3000 amino acid residues, wherein the XTEN is characterized in that the sum of glycine (G), alanine (A), serine (S), threonine (T), glutamate (E) and proline (P) residues constitutes more than about 80%, or about 85%, or about 90%, or about 95%, or about 96%, or about 97%, or about 98%, or about 99% of the total amino acid sequence of the XTEN, the XTEN sequence is substantially non-repetitive, the XTEN sequence lacks a predicted T-cell epitope when analyzed by TEPITOPE algorithm, wherein the TEPITOPE algorithm prediction for epitopes within the XTEN sequence is based on a score of –5, or –6, or –7, or –8, or –9 or greater, the XTEN sequence has greater than 90%, or greater than 91%, or greater than 92%, or greater than 93%, or greater than 94%, or greater than 95%, or greater than 96%, or greater than 96%, or greater than 98%, or greater than 99% random coil formation as determined by GOR algorithm, and the XTEN sequence has less than 2% alpha helices and 2% beta-sheets as determined by Chou-Fasman algorithm.

In another embodiment, the invention provides XTEN comprising greater than about 400 to about 3000 amino acid residues, wherein the XTEN is characterized in that the sum of asparagine and glutamine residues is less than 10% of the total amino acid sequence of the XTEN, the sum of methionine and tryptophan residues is less than 2% of the total amino acid sequence of the XTEN, the XTEN sequence has less than 5% amino acid residues with a positive charge, the XTEN sequence has greater than 90% random coil formation as determined by GOR algorithm and the XTEN sequence has less than 2% alpha helices and 2% beta-sheets as determined by Chou-Fasman algorithm.

In another embodiment, the invention provides XTEN comprising greater than about 400 to about 3000 amino acid residues, wherein the XTEN is characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 9 to about 14 amino acid residues and wherein the sequence of any two contiguous amino acid residues does not occur more than twice in each of the sequence motifs the sequence motifs consist of four to six types of amino acids selected from glycine (G), alanine (A), serine (S), threonine (T), glutamate (E) and proline (P), and the XTEN enhances pharmacokinetic properties of a biologically active protein when linked to the biologically active protein wherein the pharmacokinetic properties are ascertained by measuring the terminal half-life of the biologically active protein administered to a subject in comparison to the XTEN linked to the biologically active protein and administered to a subject at a comparable dose.

In some cases of the foregoing embodiments, no one type of amino acid constitutes more than 30% of the XTEN sequence. In other cases of the foregoing embodiments, the XTEN can have a sequence in which no three contiguous amino acids are identical unless the amino acid is serine, in which case no more than three contiguous amino acids are serine residues. In other cases of the foregoing embodiments, the XTEN sequence has a subsequence score of less than 10, or 9, or 8, or 7, or 6. In still other cases of the foregoing embodiments, at least about 80%, or about 90%, or about 95%, or about 96%, or about 97%, or about 98%, or about 99%, or 100% of the XTEN sequence consists of non-overlapping sequence motifs, wherein each of the sequence motifs has 12 amino acid residues. In one embodiment, the XTEN sequence consists of non-overlapping sequence motifs, wherein the sequence motifs are from one or more sequences of Table 1.

In some embodiments, the enhanced pharmacokinetic property of the resulting fusion protein encompasses an increase in terminal half-life of at least about two fold, or at least about three-fold, or at least about four-fold, or at least about five-fold, or at least about six-fold, or at least about eight-fold, or at least about ten-fold. In some cases, the enhanced pharmacokinetic property is reflected by the fact that the blood concentrations that remain within the therapeutic window for the fusion protein for a given period are at least about two fold, or at least about three-fold, or at least about four-fold, or at least about five-fold, or at least about six-fold, or at least about eight-fold, or at least about ten-fold longer compared to the corresponding BP not linked to XTEN. The increase in half-life and time spent within the therapeutic window can permit less frequent dosing and decreased amounts of the fusion protein (in moles equivalent) that are administered to a subject, compared to the corresponding BP not linked to XTEN. In one embodiment, the therapeutically effective dose regimen results in a gain in time of at least two-fold, or at least three-fold, or at least four-fold, or at least five-fold, or at least six-fold, or at least eight-fold, or at least 10-fold between at least two consecutive $C_{max}$ peaks and/or $C_{min}$ troughs for blood levels of the fusion protein compared to the corresponding BP not linked to the fusion protein and administered using a comparable dose regimen to a subject.

In one embodiment, at least about 80%, at least about 85%, at least about 90%, at least about 95%, or about 99% of the XTEN comprises motifs selected from one or more sequences of Table 1. In another embodiment, an XTEN exhibits at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from Table 2.

In some cases, the XTEN enhances thermostability of a biologically active protein when linked to the biologically active protein wherein the thermostability is ascertained by measuring the retention of biological activity after exposure to a temperature of about 37° C. for at least about 7 days of the biologically active protein in comparison to the XTEN linked to the biologically active protein. In one embodiment of the foregoing, the retention of biological activity is increased by at least about 50%, at least about 60%, at least about 70%, at least about 80%, at least about 90%, at least about 100%, or about 150%, at least about 200%, at least about 300%, or about 500% longer compared to the BP not linked to the XTEN comprises of the XTEN.

In another aspect, the invention provides an isolated fusion protein comprising an XTEN of any of the foregoing embodiments linked to a biologically active protein (BP). In some embodiments, the BP of the fusion protein exhibits at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from Table 3, Table 4, Table 5, Table 6, Table 7, and Table 8. In another embodiment of the foregoing, the isolated fusion protein further comprises a second XTEN sequence wherein the cumulative total of amino acid residues in the XTEN sequences is greater than about 400 to about 3000 residues.

In some cases, the isolated fusion protein with an XTEN of one of the foregoing embodiments comprises a BP wherein the BP is a glucose regulating peptide. In one embodiment of the foregoing, the glucose regulating peptide is exendin-4. In another embodiment of the foregoing, the glucose regulating peptide is glucagon.

In other cases, the isolated fusion protein comprises a BP wherein the BP is a metabolic protein. In one embodiment of the foregoing, the metabolic protein is IL-1ra.

In still other cases, the isolated fusion protein comprises a BP wherein the BP is a coagulation factor. In one embodiment of the foregoing, the coagulation factor is factor IX. In another embodiment of the foregoing, the coagulation factor is factor VII.

In other cases, the isolated fusion protein comprises a BP wherein the BP is growth hormone.

In one embodiment, the isolated fusion protein can be less immunogenic compared to the biologically active protein not linked to the XTEN, wherein immunogenicity is ascertained by measuring production of IgG antibodies selectively binding to the biologically active protein after administration of comparable doses to a subject.

The fusion protein comprising XTEN and BP of the foregoing embodiments can comprise a spacer sequence between the BP and XTEN, wherein the spacer sequence comprises between about 1 to about 50 amino acid residues that optionally comprises a cleavage sequence. In one embodiment, the cleavage sequence is susceptible to cleavage by a protease. Non-limiting examples of such protease include FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A.

In some cases, the isolated fusion protein is configured to have reduced binding affinity for a target receptor of the corresponding BP, as compared to the corresponding BP not linked to the fusion protein. In one embodiment, the fusion protein exhibits binding for a target receptor of the BP in the range of about 0.01%-30%, or about 0.1% to about 20%, or about 1% to about 15%, or about 2% to about 10% of the binding capability of the corresponding BP that is not linked to the fusion protein. In a related embodiment, a fusion protein with reduced affinity can have reduced receptor-mediated clearance and a corresponding increase in half-life of at least about 50%, or at least about 60%, or at least about 70%, or at least about 80%, or at least about 90%, or at least about 100%, or at least about 150%, or at least about 200%, or at least about 300%, or at least about 500% compared to the corresponding BP that is not linked to the fusion protein.

In one embodiment, the invention provides an isolated fusion protein that exhibits at least about 80%, or at least about 90%, or at least about 91%, or at least about 92%, or at least about 93%, or at least about 94%, or at least about 95%, or at least about 96%, or at least about 97%, or at least about 98%, or at least about 99%, or 100% sequence identity to a sequence selected from Table 40, Table 41, Table 42, Table 43, and Table 44.

In one embodiment, the invention provides compositions comprising a fusion protein, wherein the fusion protein comprises at least a first BP comprising a sequence that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence from any one of Tables 3-8, wherein the BP is linked to one or more extended recombinant polypeptides (XTEN) each comprising greater than about 100 to about 3000 amino acid residues, more preferably greater than about 400 to about 3000 amino acid residues, with a substantially non-repetitive sequence wherein the sum of glycine (G), alanine (A), serine (S), threonine (T), glutamate (E) and proline (P) residues constitutes more than about 80%, or about 85%, or about 90%, or about 95%, or about 96%, or about 97%, or about 98%, or about 99% of the total amino acid sequence of the XTEN. The XTEN component of the BPXTEN can lack a predicted T-cell epitope when analyzed by TEPITOPE algorithm, wherein the TEPITOPE algorithm prediction for epitopes within the XTEN sequence is based on a score of −7 or greater, or −8 or greater, or −9 or greater. The XTEN component of the BPXTEN can have a sequence with greater than 80%, or about 85%, or about 90%, or about 91%, or about 92%, or about 93%, or about 94%, or about 95%, or about 96%, or about 97%, or about 98%, or about 99% random coil formation as determined by GOR algorithm; and the XTEN sequence can have less than 2% alpha helices and 2% beta-sheets as determined by Chou-Fasman algorithm.

In some embodiments, the invention provides BPXTEN fusion proteins wherein the BPXTEN administered to a subject exhibits an increase in the terminal half-life for the BPXTEN compared to the corresponding BP not linked to the fusion protein of at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold or greater increase in terminal half-life compared to the BP not linked to the fusion protein.

In some embodiments, the invention provides BPXTEN fusion proteins wherein the BPXTEN exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the BP not linked to the fusion protein.

In some embodiments, BPXTEN fusion proteins exhibit an increased apparent molecular weight as determined by size exclusion chromatography, compared to the actual molecular weight, wherein the apparent molecular weight is at least about 100 kD, or at least about 150 kD, or at least about 200 kD, or at least about 300 kD, or at least about 400 kD, or at least about 500 kD, or at least about 600 kD, or at least about 700 kD, while the actual molecular weight of each BP component of the fusion protein is less than about 25 kD. Accordingly, the BPXTEN fusion proteins can have an Apparent Molecular Weight that is about 4-fold greater, or about 5-fold greater, or about 6-fold greater, or about 7-fold greater, or about 8-fold greater than the actual molecular weight of the fusion protein. In some cases, the isolated fusion protein of the foregoing embodiments exhibits an apparent molecular weight factor under physiologic conditions that is greater than about 4, or about 5, or about 6, or about 7, or about 8.

The invention provides BPXTEN in various configurations wherein the BP retains at least a portion of the biologic activity of the corresponding BP not linked to XTEN. In one embodiment, the BPXTEN comprises a BP linked to an XTEN in the configuration of formula I (BP)-(S)$_x$-(XTEN)    I wherein independently for each occurrence, BP is a biologically active protein as described hereinabove; S is a spacer sequence having between 1 to about 50 amino acid residues that can optionally include a cleavage sequence (as described above); x is either 0 or 1; and XTEN is an extended recombinant polypeptide (as described herein). The embodiment has particular utility where the BP requires a free N-terminus for desired biological activity or where linking of the C-terminus of the BP to the fusion protein reduces biological activity and it is desired to reduce the biological activity and/or side effects of the administered BPXTEN.

In another embodiment of the BPXTEN configuration, the invention provides a fusion protein in the configuration of formula II (components as described above):

$$\text{(XTEN)-(S)}_x\text{-(BP)} \qquad \text{II}$$

The embodiment is particularly useful where the BP requires a free C-terminus for desired biological activity, or where linking of the N-terminus of the BP to the fusion protein reduces biological activity and it is desired to reduce the biological activity and/or side effects of the administered BPXTEN.

In another aspect, the invention provides isolated BPXTEN fusion proteins comprising two molecules of the BP and optionally comprising a second XTEN and/or a spacer sequence wherein the fusion protein has a configuration selected from formula III, formula IV, and formula V:

$$\text{(BP)-(S)}_w\text{-(XTEN)-(S)}_x\text{-(BP)-(S)}_y\text{-(XTEN)}_z \qquad \text{III}$$

$$\text{(XTEN)-(S)}_w\text{-(BP)-(S)}_x\text{-(XTEN)}_y\text{-(BP)} \qquad \text{IV}$$

$$\text{(BP)-(S)}_x\text{-(BP)-(S)}_y\text{-(XTEN)} \qquad \text{V}$$

wherein independently for each occurrence BP is a biologically active protein as described hereinabove, S is a spacer sequence having between 1 to about 50 amino acid residues that optionally comprises a cleavage sequence; w is either 0 or 1; x is either 0 or 1; y is either 0 or 1; z is either 0 or 1; and XTEN is an extended recombinant polypeptide (as described herein) wherein the cumulative total of XTEN amino acid residues is greater than 400 to about 3000.

In another aspect, the invention provides isolated fusion proteins comprising one molecule of the BP and two molecules of XTEN and optionally one or two spacer sequences, wherein the fusion protein is of formula VI:

$$\text{(XTEN)-(S)}_x\text{-(BP)-(S)}_y\text{-(XTEN)} \qquad \text{VI}$$

wherein independently for each occurrence BP is a biologically active protein, S is a spacer sequence having between 1 to about 50 amino acid residues that optionally comprises a cleavage sequence; w is either 0 or 1; x is either 0 or 1; y is either 0 or 1; z is either 0 or 1; and XTEN is an extended recombinant polypeptide (as described herein) wherein the cumulative total of XTEN amino acid residues is greater than 400 to about 3000.

Thus, the fusion proteins can be designed to have different configurations, N- to C-terminus, of a BP, XTEN, and optional spacer sequences, including but not limited to XTEN-BP, BP-XTEN, XTEN-S-BP, BP-S-XTEN, XTEN-BP-XTEN, BP-BP-XTEN, XTEN-BP-BP, BP-S-BP-XTEN, and XTEN-BP-S-BP. The choice of configuration can, as disclosed herein, confer particular pharmacokinetic, physico/chemical, or pharmacologic properties.

In one embodiment, the BPXTEN fusion proteins of formulas I, II, III, IV, or V, or VI described above exhibit a biological activity of at least about 40%, or at least about 50%, or at least about 60%, or at least about 70%, or at least about 80%, or at least about 90%, or at least about 95% of the biological activity compared to the BP not linked to the fusion protein. In another embodiment, the BPXTEN fusion proteins of formula I, II, III, IV, or V bind the same receptors or ligands as the corresponding parental biologically active protein that is not covalently linked to the fusion protein.

The invention provides isolated nucleic acids comprising a polynucleotide sequence selected from (a) a polynucleotide encoding the fusion protein of any of the foregoing embodiments, or (b) the complement of the polynucleotide of (a). In one embodiment of the foregoing, the isolated nucleic acid comprises a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity to (a) a polynucleotide sequence that encodes a polypeptide selected from Table 40, Table 41, Table 42, Table 43, and Table 44; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a prokaryotic signal sequence. In one embodiment, the secretion signal sequence is selected from OmpA, DsbA, and PhoA signal sequences.

The invention provides a host cell, which can comprise an expression vector disclosed in the foregoing paragraph. In one embodiment, the host cell is a prokaryotic cell. In another embodiment, the host cell is *E. coli*.

In one embodiment, the invention provides pharmaceutical compositions comprising the fusion protein of any of the foregoing embodiments and at least one pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to a subject.

The invention further provides use of the pharmaceutical compositions comprising the fusion protein of any of the foregoing embodiments in the preparation of a medicament for treating a disease condition in a subject in need thereof. In one embodiment of the foregoing, the disease, disorder or condition, comprising administering the pharmaceutical composition described above to a subject in need thereof. In one embodiment of the foregoing, the disease, disorder or condition is selected from type 1 diabetes, type 2 diabetes, obesity, hyperglycemia, hyperinsulinemia, decreased insulin production, insulin resistance, syndrome X, hibernating myocardium or diabetic cardiomyopathy, excessive appetite, insufficient satiety, metabolic disorder, glucagonomas, polycystic ovary syndrome, dyslipidemia, hibernating myocardium, insufficient urinary sodium excretion, excessive urinary potassium concentration, conditions or disorders associated with toxic hypervolemia, diabetic cardiomyopathy, and retinal neurodegenerative processes. In some cases, the pharmaceutical composition can be administered subcutaneously, intramuscularly, or intravenously. In one embodiment, the pharmaceutical composition is administered at a therapeutically effective dose. In some cases of the foregoing, the therapeutically effective dose results in a gain in time spent within a therapeutic window for the fusion protein compared to the corresponding BP of the fusion protein not linked to the fusion protein and administered at a comparable dose to a subject. The gain in time spent within the therapeutic window can at least three-fold greater than the corresponding BP not linked to the fusion protein, or alternatively, at least four-fold, or five-fold, or six-fold, or seven-fold, or eight-fold, or nine-fold, or at least 10-fold, or at least 20-fold greater than the corresponding BP not linked to the fusion protein.

In another embodiment, invention provides a method of treating a disease, disorder or condition, comprising administering the pharmaceutical composition described above to a subject using multiple consecutive doses of the pharmaceutical composition administered using a therapeutically effective dose regimen. In one embodiment of the foregoing, the therapeutically effective dose regimen can result in a gain in time of at least three-fold, or alternatively, at least four-fold, or five-fold, or six-fold, or seven-fold, or eight-fold, or nine-fold, or at least 10-fold, or at least 20-fold between at least two consecutive $C_{max}$ peaks and/or $C_{min}$ troughs for blood levels of the fusion protein compared to the corresponding BP of the fusion protein not linked to the fusion protein and administered at a comparable dose regimen to a subject. In another embodiment of the foregoing, the administration of the fusion protein results in a comparable improvement in at least one measured parameter using less frequent dosing or a lower total dosage in moles of the fusion protein of the pharmaceutical composition compared to the corresponding biologically active protein component(s) not linked to the fusion protein and administered to a subject d using a therapeutically effective regimen to a subject. The parameter can be selected from fasting glucose level, response to oral glucose tolerance test, peak change of postprandial glucose from baseline, $HA_{1c}$, caloric intake, satiety, rate of gastric emptying, insulin secretion, peripheral insulin sensitivity, response to insulin challenge, beta cell mass, body weight, prothrombin time, bleeding time, thrombin-antithrombin III complex (TAT), D-dimer, incidence of bleeding episodes, erythrocyte sedimentation rate (ESR), C-reactive protein, bone density, muscle mass, blood pressure, plasma triglycerides, HDL, cholesterol, LDL cholesterol, incidence of angina, and cardiac output.

In another aspect, the invention provides a method of improving a property of a biologically active protein, comprising the step of linking a biologically active protein to the XTEN of any of the foregoing embodiments to achieve a property characterized in that (a) terminal half-life of the biologically active protein linked to the XTEN is longer as compared to the terminal half-life of the biologically active protein that is not linked to the XTEN; (b) shelf-life of the biologically active protein linked to the XTEN is longer as compared to the shelf-life of the biologically active protein that is not linked to the XTEN, wherein shelf-life is ascertained by retention of biological activity after an interval compared to a baseline sample; (c) solubility under physiologic conditions of the biologically active protein linked to the XTEN is increased as compared to the solubility of the biologically active protein that is not linked to the XTEN; (d) production of IgG antibodies selectively binding to the biologically active protein linked to the XTEN when administered to a subject is reduced as compared to production of the IgG when the biologically active protein not linked to the XTEN is administered to a subject at a comparable dose; and/or (e) time spent within the therapeutic window of the biologically active protein linked to the XTEN when administered to a subject is longer as compared to the biologically active protein that is not linked to the XTEN when administered to a subject.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1A shows two different configurations of BPXTEN fusion proteins (100), each comprising a single biologically active protein (BP) and an XTEN, the first of which has an XTEN molecule (102) attached to the C-terminus of a BP (103), and the second of which has an XTEN molecule attached to the N-terminus of a BP (103). FIG. 1B shows two different configurations of BPXTEN fusion proteins (100), each comprising a single BP, a spacer sequence and an XTEN, the first of which has an XTEN molecule (102) attached to the C-terminus of a spacer sequence (104) and the spacer sequence attached to the C-terminus of a BP (103) and the second of which has an XTEN molecule attached to the N-terminus of a spacer sequence (104) and the spacer sequence attached to the N-terminus of a BP (103). FIG. 1C shows two different configurations of BPXTEN fusion proteins (101), each comprising two molecules of a single BP and one molecule of an XTEN, the first of which has an XTEN linked to the C-terminus of a first BP and that BP is linked to the C-terminus of a second BP, and the second of which is in the opposite orientation in which the XTEN is linked to the N-terminus of a first BP and that BP is linked to the N-terminus of a second BP. FIG. 1D shows two different configurations of BPXTEN fusion proteins (101), each comprising two molecules of a single BP, a spacer sequence and one molecule of an XTEN, the first of which has an XTEN linked to the C-terminus of a spacer sequence and the spacer sequence linked to the C-terminus of a first BP which is linked to the C-terminus of a second BP, and the second of which is in the opposite orientation in which the XTEN is linked to the N-terminus of a spacer sequence and the spacer sequence is linked to the N-terminus of a first BP that that BP is linked to the N-terminus of a second BP. FIG. 1E shows two different configurations of BPXTEN fusion proteins (101), each comprising two molecules of a single BP, a spacer sequence and one molecule of an XTEN, the first of which has an XTEN linked to the C-terminus of a first BP and the first BP linked to the C-terminus of a spacer sequence which is linked to the C-terminus of a second BP molecule, and the second of which is in the opposite configuration of XTEN linked to the N-terminus of a first BP which is linked to the N-terminus of a spacer sequence which in turn is linked to the N-terminus of a second molecule of BP. FIG. 1F shows two different configurations of BPXTEN fusion proteins (105), each comprising two molecules of a single BP, and two molecules of an XTEN, the first of which has a first XTEN linked to the C-terminus of a first BP which is linked to the C-terminus of a second XTEN that is linked to the C-terminus of a second molecule of BP, and the second of which is in the opposite configuration of XTEN linked to the N-terminus of a first BP linked to the N-terminus of a second XTEN linked to the N-terminus of a second BP. FIG. 1G shows a configuration (106) of a single BP linked to two XTEN at the N- and C-termini of the BP.

FIG. 3A shows a BPXTEN fusion protein (101) in which a BP (103) and an XTEN (102) are linked by spacer sequences that contain a cleavable sequence (104), the latter being susceptible to MMP-13 protease (105). FIG. 3B shows the reaction products of a free BP, spacer sequence and XTEN. FIG. 3C shows the interaction of the reaction product free BP (103) or BPXTEN fusion protein (101) with target receptors (106) to BP on a cell surface (107). In this case, desired binding to the receptor is exhibited when BP has a free C-terminus, as evidenced by the binding of free BP (103) to the receptor while uncleaved fusion protein does not bind tightly to the receptor. FIG. 3D shows that the free BP (103), with high binding affinity, remains bound to the receptor (106), while an intact BPXTEN (101) is released from the receptor. FIG. 3E shows the bound BP has been internalized into an endosome (108) within the cell (107), illustrating receptor-mediated clearance of the bound BP and triggering cell signaling (109), portrayed as stippled cytoplasm.

FIG. 7A shows an expression vector encoding XTEN fused to the 3' end of the sequence encoding biologically active protein IL-1ra. Note that no additional leader sequences are required in this vector. FIG. 7B depicts an expression vector encoding XTEN fused to the 5' end of the sequence encoding IL-1ra with a CBD leader sequence and a TEV protease site. FIG. 7C depicts an expression vector as in FIG. 7B where the CBD and TEV processing site have been replaced with an optimized N-terminal leader sequence (NTS). FIG. 7D depicts an expression vector encoding an NTS sequence, an XTEN, a sequence encoding IL-1ra, and than a second sequence encoding an XTEN.

FIG. 9 shows three randomized libraries used for the third and fourth codons in the N-terminal sequences of clones from LCW546, LCW547 and LCW552. The libraries were designed with the third and fourth residues modified such that all combinations of allowable XTEN codons were present at these positions, as shown. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of the three libraries LCW0569 (SEQ ID NOS 1,708 and 1,709), LCW0570 (SEQ ID NOS 1,710 and 1,711), and LCW0571 (SEQ ID NOS 1,712 and 1,713).

FIG. 26A shows measured terminal half-life versus body mass, with a predicted T1/2 in humans of 139 h. FIG. 26B shows measured drug clearance versus body mass, with a predicted clearance rate value of 30 ml/h in humans. FIG. 26C shows measured volume of distribution versus body mass, with a predicted value of 5970 ml in humans.

FIG. 29 shows the effects of heat treatment on stability of hGH and AM864-hGH. FIG. 29A is an SDS-PAGE gel of the two preparations treated at 25° C. and 80° C. for 15 minutes, while FIG. 29B shows the corresponding percentage of receptor binding activity of the 80° C. sample relative to the 25° C. treatment.

FIG. 35 shows the comparative effects of administration of placebo, hGH, and AM864-hGH on growth of cartilage in the tibial epiphyseal plate in hypox rats, shown in histologic cross-sections of the tibia after 9 days of treatment (groups were those used as per FIG. 34).

FIG. 36 shows a schematic representation of exemplary FIX and FIX-XTEN fusion proteins. FIG. 36A shows the domain architecture of native FIX, with the gamma-carboxy-glutamate domain, the EGF1 and EGF2 domains, the activation peptide, and the protease domain. Arrows indicate the cleavage sites for the activation peptide domain. FIG. 36B shows a FIX molecule with an XTEN polypeptide attached to the C-terminus, and indicates a site for proteolytic cleavage to release the XTEN.

FIG. 37A shows an FIX-XTEN with two proteolytic cleavage sites (arrows) within the XTEN, proximal to the FIX portion of the fusion protein. FIG. 37B shows an FIX-XTEN that can be autocatalytically activated, with release of the XTEN. FIG. 37C shows four configurations of FIX-XTEN, with the XTEN integrated between the various domains of FIX. FIG. 37D shows an FIX-XTEN with the XTEN portion inserted into the activation peptide, which would release the XTEN upon the proteolytic activation of FIX. FIG. 37E illustrates FIX-XTEN that contain multiple XTEN sequences inserted between different domains. FIG. 37F illustrates FIX-XTEN where the XTEN has been inserted within a domain of FIX. FIG. 37G illustrates FIX-XTEN where the XTEN is linked to the C-terminus of FIX and contains multiple cleavage sites near the N-terminus of the XTEN

FIG. 41A is a schematic of three representative FIX-XTEN constructs AC296, AC299, and AC300. Two arrows in the FIX sequence indicate the FXI activation site. The additional arrow in AC299 and AC300 illustrates the XTEN release site. FIG. 41B is a Western blot of thrombin treated proteins AC296, AC299, and AC300 which shows, in the circle, that FIX has been released from the XTEN moiety, at a similar location as the FIX positive control on the left side of the Western blot.

FIG. 43A is a schematic of the unprocessed FIX polypeptide chain which is the expressed product, and the matured FIX polypeptide chain that includes the post translation cleavage at the N-terminus that occurs during secretion of FIX. FIG. 8B is a matching schematic of FIXa showing the residue numbers of the removed activation peptide in both the unprocessed and the mature forms.

FIG. 44 is a chart showing the sequence of the FIX-XTEN construct FIX-CFXIa-AG864 (SEQ ID NO: 1819), pre-FXIa cleavage, and the resulting fragments 1, 2, 3 and 4 (SEQ ID NOS 1820-1823, respectively, in order of appearance) after proteolytic cleavage and activation to FIXa.

DETAILED DESCRIPTION OF THE INVENTION

Figure 1:
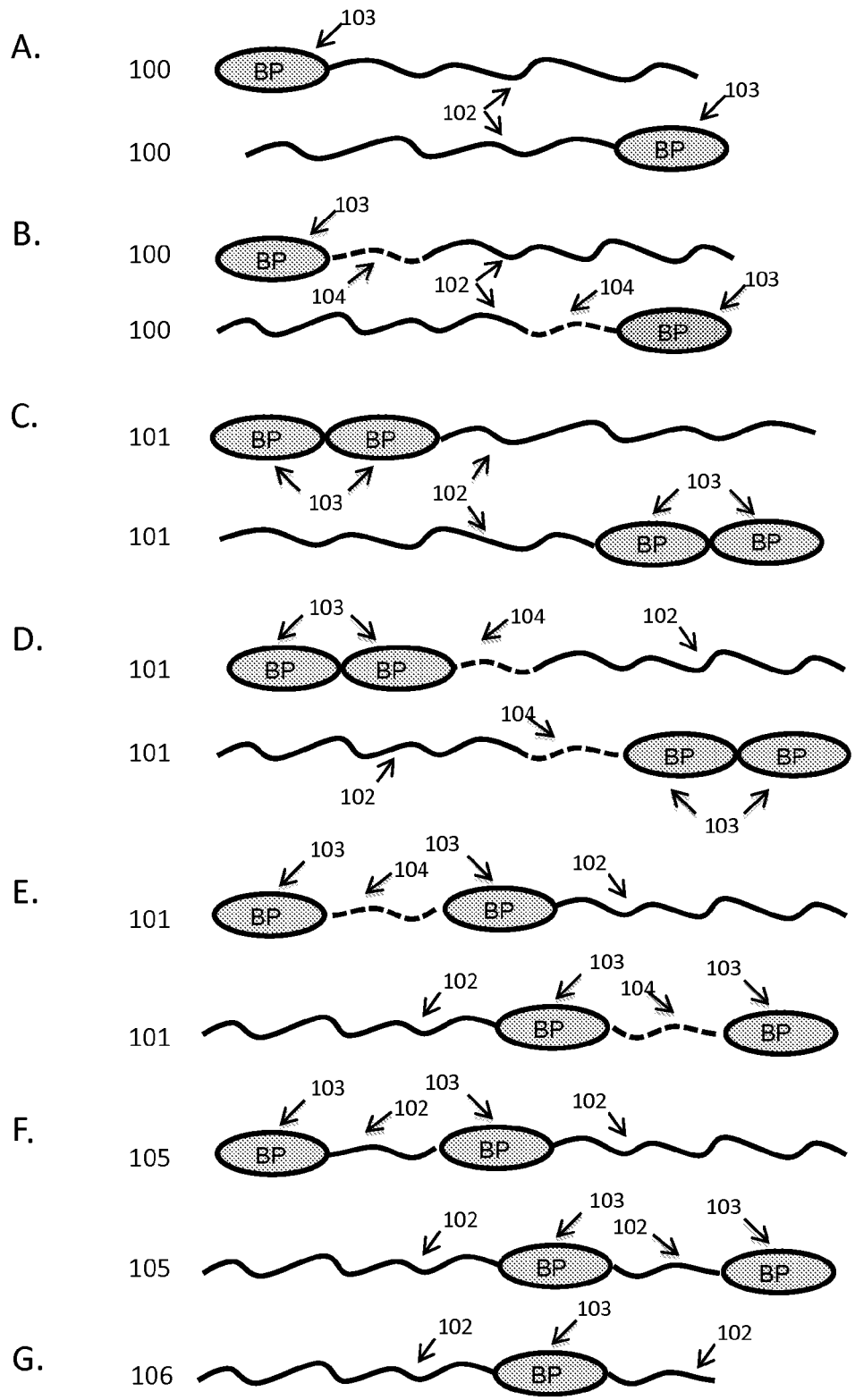
FIG. 1 shows schematic representations of exemplary BPXTEN fusion proteins (FIGS. 1A-G), all depicted in an N- to C-terminus orientation.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity with the reference biologically active protein. As used herein, the term "biologically active protein moiety" includes proteins modified deliberately, as for example, by site directed mutagenesis, insertions, or accidentally through mutations.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two more chemical elements or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two ore more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" or "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity to those sequences.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60 to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point © for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, $2^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, for example, as defined by a particular SEQ ID number, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, for example, as defined by a particular SEQ ID number, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Apparent Molecular Weight Factor" or "Apparent Molecular Weight" are related terms referring to a measure of the relative increase or decrease in apparent molecular weight exhibited by a particular amino acid sequence. The Apparent Molecular Weight is determined using size exclusion chromatography (SEC) and similar methods compared to globular protein standards and is measured in "apparent kD" units. The Apparent Molecular Weight Factor is the ratio between the Apparent Molecular Weight and the actual molecular weight; the latter predicted by adding, based on amino acid composition, the calculated molecular weight of each type of amino acid in the composition.

The "hydrodynamic radius" or "Stokes radius" is the effective radius ($R_h$, in nm) of a molecule in a solution measured by assuming that it is a body moving through the solution and resisted by the solution's viscosity. In the embodiments of the invention, the hydrodynamic radius measurements of the XTEN fusion proteins correlate with the 'Apparent Molecular Weight Factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refer to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers is listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Examples for activation are the reaction of a carboxyl group with carbodiimide, the conversion of a carboxyl group into an activated ester, or the conversion of a carboxyl group into an azide function.

"Controlled release agent", "slow release agent", "depot formulation" or "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" or "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker which may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect", as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose", as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial.

The term "therapeutically effective dose regimen", as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N.J., 2000, the contents of which are incorporated in their entirety herein by reference.

II). Extended Recombinant Polypeptides

The present invention provides compositions comprising extended recombinant polypeptides ("XTEN" or "XTENs"). In some embodiments, XTEN are generally extended length polypeptides with non-naturally occurring, substantially non-repetitive sequences that are composed mainly of small hydrophilic amino acids, with the sequence having a low degree or no secondary or tertiary structure under physiologic conditions.

In one aspect of the invention, XTEN polypeptide compositions are disclosed that are useful as fusion partners that can be linked to biologically active proteins ("BP"), resulting in a BPXTEN fusion proteins (e.g., monomeric fusions). XTENs can have utility as fusion protein partners in that they can confer certain chemical and pharmaceutical properties when linked to a biologically active protein to a create a fusion protein. Such desirable properties include but are not limited to enhanced pharmacokinetic parameters and solubility characteristics, amongst other properties described below. Such fusion protein compositions may have utility to treat certain diseases, disorders or conditions, as described herein. As used herein, "XTEN" specifically excludes antibodies or antibody fragments such as single-chain antibodies, Fc fragments of a light chain or a heavy chain.

In some embodiments, XTEN are long polypeptides having greater than about 100 to about 3000 amino acid residues, preferably greater than 400 to about 3000 residues when used as a single sequence, and cumulatively have greater than about 400 to about 3000 amino acid residues when more than one XTEN unit is used in a single fusion protein or conjugate. In other cases, where an increase in half-life of the fusion protein is not needed but where an increase in solubility or other physico/chemical property for the biologically active protein fusion partner is desired, an XTEN sequence shorter than 100 amino acid residues, such as about 96, or about 84, or about 72, or about 60, or about 48, or about 36 amino acid residues may be incorporated into a fusion protein composition with the BP to effect the property.

The selection criteria for the XTEN to be linked to the biologically active proteins to create the inventive fusion proteins generally relate to attributes of physical/chemical properties and conformational structure of the XTEN that can be, in turn, used to confer enhanced pharmaceutical and pharmacokinetic properties to the fusion proteins. The XTEN of the present invention may exhibit one or more of the following advantageous properties: conformational flexibility, enhanced aqueous solubility, high degree of protease resistance, low immunogenicity, low binding to mammalian receptors, and increased hydrodynamic (or Stokes) radii; properties that can make them particularly useful as fusion protein partners. Non-limiting examples of the properties of the fusion proteins comprising BP that may be enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as terminal half-life and area under the curve (AUC), slower absorption after subcutaneous or intramuscular injection (compared to BP not linked to XTEN) such that the $C_{max}$ is lower, which may, in turn, result in reductions in adverse effects of the BP that, collectively, can result in an increased period of time that a fusion protein of a BPXTEN composition administered to a subject remains within a therapeutic window, compared to the corresponding BP component not linked to XTEN.

A variety of methods and assays are known in the art for determining the physical/chemical properties of proteins such as the fusion protein compositions comprising the inventive XTEN; properties such as secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

Typically, the XTEN component of the fusion proteins are designed to behave like denatured peptide sequences under physiological conditions, despite the extended length of the polymer. Denatured describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some cases, the invention provides XTEN sequences that, under physiologic conditions, can resemble denatured sequences largely devoid in secondary structure. In other cases, the XTEN sequences can be substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the means described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some cases, the XTEN sequences used in the inventive fusion protein compositions can have an alpha-helix percentage ranging from 0% to less than about 5% as determined by a Chou-Fasman algorithm. In other cases, the XTEN sequences of the fusion protein compositions can have a beta-sheet percentage ranging from 0% to less than about 5% as determined by a Chou-Fasman algorithm. In some cases, the XTEN sequences of the fusion protein compositions can have an alpha-helix percentage ranging from 0% to less than about 5% and a beta-sheet percentage ranging from 0% to less than about 5% as determined by a Chou-Fasman algorithm. In preferred embodiments, the XTEN sequences of the fusion protein compositions will have an alpha-helix percentage less than about 2% and a beta-sheet percentage less than about 2%. In other cases, the XTEN sequences of the fusion protein compositions can have a high degree of random coil percentage, as determined by a GOR algorithm. In some embodiments, an XTEN sequence can have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by a GOR algorithm.

1. Non-Repetitive Sequences

XTEN sequences of the subject compositions can be substantially non-repetitive. In general, repetitive amino acid sequences have a tendency to aggregate or form higher order structures, as exemplified by natural repetitive sequences such as collagens and leucine zippers, or form contacts resulting in crystalline or pseudocrystalline structures. In contrast, the low tendency of non-repetitive sequences to aggregate enables the design of long-sequence XTENs with a relatively low frequency of charged amino acids that would be likely to aggregate if the sequences were otherwise repetitive. Typically, the BPXTEN fusion proteins comprise XTEN sequences of greater than about 100 to about 3000 amino acid residues, preferably greater than 400 to about 3000 residues, wherein the sequences are substantially non-repetitive. In one embodiment, the XTEN sequences can have greater than about 100 to about 3000 amino acid residues, preferably greater than 400 to about 3000 amino acid residues, in which no three contiguous amino acids in the sequence are identical amino acid types unless the amino acid is serine, in which case no more than three contiguous amino acids are serine residues. In the foregoing embodiment, the XTEN sequence would be substantially non-repetitive.

The degree of repetitiveness of a polypeptide or a gene can be measured by computer programs or algorithms or by other means known in the art. Repetitiveness in a polypeptide sequence can, for example, be assessed by determining the number of times shorter sequences of a given length occur within the polypeptide. For example, a polypeptide of 200 amino acid residues has 192 overlapping 9-amino acid sequences (or 9-mer "frames") and 198 3-mer frames, but the number of unique 9-mer or 3-mer sequences will depend on the amount of repetitiveness within the sequence. A score can be generated (hereinafter "subsequence score") that is reflective of the degree of repetitiveness of the subsequences in the overall polypeptide sequence. In the context of the present invention, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 73. In some embodiments, the present invention provides BPXTEN each comprising XTEN in which the XTEN can have a subsequence score less than 12, more preferably less than 10, more preferably less than 9, more preferably less than 8, more preferably less than 7, more preferably less than 6, and most preferably less than 5. In the embodiments hereinabove described in this paragraph, an XTEN with a subsequence score less than about 10 (i.e., 9, 8, 7, etc.) would be "substantially non-repetitive."

The non-repetitive characteristic of XTEN can impart to fusion proteins with BP(s) a greater degree of solubility and less tendency to aggregate compared to polypeptides having repetitive sequences. These properties can facilitate the formulation of XTEN-comprising pharmaceutical preparations containing extremely high drug concentrations, in some cases exceeding 100 mg/ml.

Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345: 1365-71; Hsu, C. T., et al. (2000) Cancer Res, 60:3701-5); Bachmann M F, et al. Eur J. Immunol. (1995) 25(12):3445-3451).

2. Exemplary Sequence Motifs

The present invention encompasses XTEN that can comprise multiple units of shorter sequences, or motifs, in which the amino acid sequences of the motifs are non-repetitive. In designing XTEN sequences, it was discovered that the non-repetitive criterion may be met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is rendered substantially non-repetitive.

In one embodiment, XTEN can have a non-repetitive sequence of greater than about 100 to about 3000 amino acid residues, preferably greater than 400 to about 3000 residues, wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly of small hydrophilic amino acids, such that the overall sequence has an unstructured, flexible characteristic. Examples of amino acids that can be included in XTEN, are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In a preferred embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 100 to about 3000 amino acid residues, preferably greater than 400 to about 3000 residues in length. In some embodiments, XTEN can have sequences of greater than about 100 to about 3000 amino acid residues, preferably greater than 400 to about 3000 residues, wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein in the content of any one amino acid type in the full-length XTEN does not exceed 30%.

In still other embodiments, XTENs comprise non-repetitive sequences of greater than about 100 to about 3000 amino acid residues, preferably greater than 400 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences would be substantially non-repetitive.

In some cases, the invention provides compositions comprising a non-repetitive XTEN sequence of greater than about 100 to about 3000 amino acid residues, preferably greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 1. In some cases, the XTEN comprises non-overlapping sequence motifs in which about 80%, or at least about 90%, or about 91%, or about 92%, or about 93%, or about 94%, or about 95%, or about 96%, or about 97%, or about 98%, or about 99% to about 100% of the sequence consists of two or more non-overlapping sequences selected from a single motif family of Table 1, resulting in a "family" sequence in which the overall sequence remains substantially non-repetitive. Accordingly, in these embodiments, an XTEN sequence can comprise multiple units of non-overlapping sequence motifs of the AD motif family, or the AE motif family, or the AF motif family, or the AG motif family, or the AM motif family, or the AQ motif family, or the BC family, or the BD family of sequences of Table 1. In other cases, the XTEN comprises motif sequences from two or more of the motif families of Table 1.

TABLE 1

XTEN Sequence Motifs of 12 Amino Acids and Motif Families

| Motif Family* | SEQ ID NO: | MOTIF SEQUENCE |
|---|---|---|
| AD | 182 | GESPGGSSGSES |
| AD | 183 | GSEGSSGPGESS |
| AD | 184 | GSSESGSSEGGP |
| AD | 185 | GSGGEPSESGSS |
| AE, AM | 186 | GSPAGSPTSTEE |
| AE, AM, AQ | 187 | GSEPATSGSETP |
| AE, AM, AQ | 188 | GTSESATPESGP |
| AE, AM, AQ | 189 | GTSTEPSEGSAP |
| AF, AM | 190 | GSTSESPSGTAP |
| AF, AM | 191 | GTSTPESGSASP |
| AF, AM | 192 | GTSPSGESSTAP |
| AF, AM | 193 | GSTSSTAESPGP |
| AG, AM | 194 | GTPGSGTASSSP |
| AG, AM | 195 | GSSTPSGATGSP |
| AG, AM | 196 | GSSPSASTGTGP |
| AG, AM | 197 | GASPGTSSTGSP |
| AQ | 198 | GEPAGSPTSTSE |
| AQ | 199 | GTGEPSSTPASE |
| AQ | 200 | GSGPSTESAPTE |
| AQ | 201 | GSETPSGPSETA |
| AQ | 202 | GPSETSTSEPGA |
| AQ | 203 | GSPSEPTEGTSA |
| BC | 1715 | GSGASEPTSTEP |
| BC | 1716 | GSEPATSGTEPS |
| BC | 1717 | GTSEPSTSEPGA |
| BC | 1718 | GTSTEPSEPGSA |

TABLE 1-continued

XTEN Sequence Motifs of 12 Amino
Acids and Motif Families

| Motif Family* | SEQ ID NO: | MOTIF SEQUENCE |
|---|---|---|
| BD | 1719 | GSTAGSETSTEA |
| BD | 1720 | GSETATSGSETA |
| BD | 1721 | GTSESATSESGA |
| BD | 1722 | GTSTEASEGSAS |

*Denotes individual motif sequences that, when used together in various permutations, results in a "family sequence"

In other cases, BPXTEN composition can comprise a non-repetitive XTEN sequence of greater than about 100 to about 3000 amino acid residues, preferably greater than 400 to about 3000 residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 12-15.

In those embodiments wherein the XTEN component of the BPXTEN fusion protein has less than 100% of its amino acids consisting of four to six amino acid selected from glycine (G), alanine (A), serine (S), threonine (T), glutamate (E) and proline (P), or less than 100% of the sequence consisting of the sequence motifs of Tables 1 or the polypeptide sequences to Tables 12-15, or less than 100% sequence identity with an XTEN from Table 2, the other amino acid residues can be selected from any other of the 14 natural L-amino acids. The other amino acids may be interspersed throughout the XTEN sequence, may be located within or between the sequence motifs, or may be concentrated in one or more short stretches of the XTEN sequence. In such cases where the XTEN component of the BPXTEN comprises amino acids other than glycine (G), alanine (A), serine (S), threonine (T), glutamate (E) and proline (P), it is preferred that the amino acids not be hydrophobic residues and should not substantially confer secondary structure of the XTEN component. Thus, in a preferred embodiment of the foregoing, the XTEN component of the BPXTEN fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by Chou-Fasman algorithm and would have at least 90% random coil formation as measured by GOR algorithm.

3. Length of Sequence

In a particular feature, the invention encompasses BPXTEN compositions comprising XTEN polypeptides with extended length sequences. The present invention makes use of the discovery that increasing the length of non-repetitive, unstructured polypeptides enhances the unstructured nature of the XTENs and the biological and pharmacokinetic properties of fusion proteins comprising the XTEN. As described more fully in the Examples, proportional increases in the length of the XTEN, even if created by a fixed repeat order of single family sequence motifs (e.g., the four AE motifs of Table 1), can result in a sequence with a higher percentage of random coil formation, as determined by GOR algorithm, compared to shorter XTEN lengths. In addition, it was discovered that increasing the length of the unstructured polypeptide fusion partner can, as described in the Examples, result in a fusion protein with a disproportional increase in terminal half-life compared to fusion proteins with unstructured polypeptide partners with shorter sequence lengths.

Non-limiting examples of XTEN contemplated for inclusion in the BPXTEN of the invention are presented in Table 2. Accordingly, the invention provides BPXTEN compositions wherein the XTEN sequence length of the fusion protein(s) is greater than about 100 to about 3000 amino acid residues, and in some cases is greater than 400 to about 3000 amino acid residues, wherein the XTEN confers enhanced pharmacokinetic properties on the BPXTEN in comparison to payloads not linked to XTEN. In some cases, the XTEN sequences of the BPXTEN compositions of the present invention can be about 100, or about 144, or about 288, or about 401, or about 500, or about 600, or about 700, or about 800, or about 900, or about 1000, or about 1500, or about 2000, or about 2500 or up to about 3000 amino acid residues in length. In other cases, the XTEN sequences can be about 100 to 150, about 150 to 250, about 250 to 400, 401 to about 500, about 500 to 900, about 900 to 1500, about 1500 to 2000, or about 2000 to about 3000 amino acid residues in length. In one embodiment, the BPXTEN can comprise an XTEN sequence wherein the sequence exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a XTEN selected from Table 2. In some cases, the XTEN sequence is designed for optimized expression as the N-terminal component of the BPXTEN. In one embodiment of the foregoing, the XTEN sequence has at least 90% sequence identity to the sequence of AE912 or AM923. In another embodiment of the foregoing, the XTEN has the N-terminal residues described in Examples 14-17.

In other cases, the BPXTEN fusion protein can comprise a first and a second XTEN sequence, wherein the cumulative total of the residues in the XTEN sequences is greater than about 400 to about 3000 amino acid residues. In embodiments of the foregoing, the BPXTEN fusion protein can comprise a first and a second XTEN sequence wherein the sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to at least a first or additionally a second XTEN selected from Table 2. Examples where more than one XTEN is used in a BPXTEN composition include, but are not limited to constructs with an XTEN linked to both the N- and C-termini of at least one BP.

As described more fully below, the invention provides methods in which the BPXTEN is designed by selecting the length of the XTEN to confer a target half-life on a fusion protein administered to a subject. In general, longer XTEN lengths incorporated into the BPXTEN compositions result in longer half-life compared to shorter XTEN. However, in another embodiment, BPXTEN fusion proteins can be designed to comprise XTEN with a longer sequence length that is selected to confer slower rates of systemic absorption after subcutaneous or intramuscular administration to a subject. In such cases, the $C_{max}$ is reduced in comparison to a comparable dose of a BP not linked to XTEN, thereby contributing to the ability to keep the BPXTEN within the therapeutic window for the composition. Thus, the XTEN confers the property of a depot to the administered BPXTEN, in addition to the other physical/chemical properties described herein.

TABLE 2

XTEN Polypeptides

| XTEN Name | SEQ ID NO: | Amino Acid Sequence |
|---|---|---|
| AE144 | 204 | GSEPATSGSETPGTSESATPESGPGSEPATSGSETPGSPAGSPTSTEEGTSTEPSEGSAP GSEPATSGSETPGSEPATSGSETPGSEPATSGSETPGTSTEPSEGSAPGTSESATPESGP GSEPATSGSETPGTSTEPSEGSAP |
| AF144 | 205 | GTSTPESGSASPGTSPSGESSTAPGTSPSGESSTAPGSTSSTAESPGPGSTSESPSGTAP GSTSSTAESPGPGTSPSGESSTAPGTSTPESGSASPGSTSSTAESPGPGTSPSGESSTAP GTSPSGESSTAPGTSPSGESSTAP |
| AE288 | 206 | GTSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGSAP GTSTEPSEGSAPGSEPATSGSETPGTSESATPESGPGTSTEPSEGSAP |
| AF504 | 207 | GASPGTSSTGSPGSSPSASTGTGPGSSPSASTGTGPGTPGSGTASSSPGSSTPSGATGS PGSXPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGTSST GSPGTPGSGTASSSPGSSTPSGATGSPGSXPSASTGTGPGSSPSASTGTGPGSSTPSGA TGSPGSSTPSGATGSPGASPGTSSTGSPGASPGTSSTGSPGASPGTSSTGSPGTPGSGT ASSSPGASPGTSSTGSPGASPGTSSTGSPGASPGTSSTGSPSPSASTGTGPGTPGSG TASSSPGASPGTSSTGSPGASPGTSSTGSPGASPGTSSTGSPGSSTPSGATGSPGSSTPS GATGSPGASPGTSSTGSPGTPGSGTASSSPGSSTPSGATGSPGSSTPSGATGSPGSSTP SGATGSPGSSPSASTGTGPGASPGTSSTGSP |
| AF540 | 208 | GSTSSTAESPGPGSTSSTAESPGPGSTSESPSGTAPGSTSSTAESPGPGSTSSTAESPGP GTSTPESGSASPGSTSESPSGTAPGTSPSGESSTAPGSTSESPSGTAPGSTSESPSGTAP GTSPSGESSTAPGSTSESPSGTAPGTSESPSGTAPGTSPSGESSTAPGSTSESPSGTAP GSTSESPSGTAPGSTSESPSGTAPGTSTPESGSASPGSTSESPSGTAPGTSTPESGSASP GSTSSTAESPGPGSTSSTAESPGPGTSTPESGSASPGTSTPESGSASPGSTSESPSGTAP GTSTPESGSASPGTSTPESGSASPGSTSESPSGTAPGSTSESPSGTAPGSTSESPSGTAP GSTSSTAESPGPGTSTPESGSASPGTSTPESGSASPGSTSESPSGTAPGSTSESPSGTAP GTSTPESGSASPGSTSESPSGTAPGTSESPSGTAPGTSTPESGSASPGTSPSGESSTAP GSTSSTAESPGPGTSPSGESSTAPGSTSSTAESPGPGTSTPESGSASPGSTSESPSGTAP |
| AD576 | 209 | GSSESGSSEGGPGSGGEPSESGSGSSESGSSEGGPGSSESGSSEGG PGSSESGSSEGGPGSSESGSSEGGPGSESPGGSSGSESGSEGSSGPGESSGSSESGSSEG GPGSSESGSSEGGPGSSESGSSEGGPGSGGEPSESGSSGESGSESGESPGGSSG SESGSGGEPSESGSSGSSESGSSEGGPGSGGEPSESGSGSGGEPSESGSSGSEGSSGP GESSGESPGGSSGSESGSGGEPSESGSSGSGGEPSESGSSGSSESGSS EGGPGESPGGSSGSESGESPGGSGSESGESPGGSSGSESGESPGGS SGSESGSSESGSSEGGPGSGGEPSESGSSGESGSSGGPGESSSESGSSEGGPGSGGEP SESGSGSSESGSSEGGPGSGGEPSESGSSGESPGGSSGSESGESPGGSSGSESGSSESG SSEGGPGSGGEPSESGSSGSSESGSSEGGPGSGGEPSESGSGSGGEPSESGSSGESPG GSSGSESGSEGSSGPGESSGSSESGSSEGGPGSEGSSGPGESS |
| AE576 | 210 | GSPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAP GTSTEPSEGSAPGTSESATPESGPGTSTEPSEGSAPGTSESATPESGPGSEPATSGSETP GTSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGSAP GTSTEPSEGSAPGTSTEPSEGSAPGTSTEPSEGSAPGSPAGSPTSTEE GTSTEPSEGSAPGTSESATPESGPGSEPATSGSETPGTSESATPESGPGSEPATSGSETP GTSESATPESGPGTSTEPSEGSAPGTSESATPESGPGSPAGSPTSTEEGSPAGSPTSTEE GSPAGSPTSTEEGTSESATPESGPGTSTEPSEGSAP |
| AF576 | 211 | GSTSSTAESPGPGSTSSTAESPGPGSTSESPSGTAPGSTSSTAESPGPGSTSSTAESPGP GTSTPESGSASPGSTSESPSGTAPGTSPSGESSTAPGSTSESPSGTAPGSTSESPSGTAP GTSPSGESSTAPGSTSESPSGTAPGTSESPSGTAPGTSPSGESSTAPGSTSESPSGTAP GSTSESPSGTAPGSTSESPSGTAPGTSTPESGSASPGSTSESPSGTAPGTSTPESGSASP GSTSSTAESPGPGSTSSTAESPGPGTSTPESGSASPGTSPESGSASPGSTSESPSGTAP GTSTPESGSASPGTSTPESGSASPGSTSESPSGTAPGSTSESPSGTAPGSTSESPSGTAP GSTSSTAESPGPGTSTPESGSASPGTSTPESGSASPGSTSESPSGTAPGSTSESPSGTAP GTSTPESGSASPGSTSESPSGTAPGTSESPSGTAPGTSTPESGSASPGTSPSGESSTAP GSTSSTAESPGPGTSPSGESSTAPGSTSSTAESPGPGTSTPESGSASPGSTSESPSGTAP GSTSSTAESPGPGTSTPESGSASPGTSTPESGSASP |
| AD836 | 212 | GSSESGSSEGGPGSSESGSSEGGPGESPGGSSGSESGSGGEPSESGSSGESPGGSSGSE SGESPGGSSGSESGSSESGSSEGGPGSSESGSSEGGPGSSESGSSEGGPGESPGGSSGS ESGESPGGSSGSESGESPGGSSGSESGSSESGSSEGGPGSSESGSSEGGPGSSESGSSE GGPGSSESGSSEGGPGSSESGSSEGGPGSSESGSSEGGPGSGGEPSESGSSGESPGGSS GSESGESPGGSSGSESGSGGEPSESGSSGSSESGSSEGGPGSSESGSSEGGPGSGGEPS ESGSSGSESGPGESSGSSESGSSEGGPGSGGEPSESGSSGESPGGSSGSESGSSGGEP SESGSSGSGGEPSESGSSGSSESGSSEGGPGSGGEPSESGSSGSGGEPSESGSSGSEGSS GPGESSGESPGGSGSESGSEGSSGPGESSGSEGSSGPGESSGGEPSESGSSGSSES |

TABLE 2-continued

XTEN Polypeptides

| XTEN Name | SEQ ID NO: | Amino Acid Sequence |
|---|---|---|
| | | GSSEGGPGSSESGSSEGGPGESPGGSSGSESGSGGEPSESGSSGSEGSSGPGESSGESP
GGSSGSESGSEGSSGPGSSESGSSEGGPGSGGEPSESGSSGSEGSSGPGESSGSEGSSG
PGESSGSEGSSGPGESSGSGGEPSESGSSGSGGEPSESGSSGPGSSGSESGSESPGG
SSGSESGSGGEPSESGSSGSEGSSGPGESSGESPGGSSGSESGSSESGSSEGGPGSSESG
SSEGGPGSSESGSSEGGPGSGGEPSESGSSGSESGSSEGGPGESPGGSSGSESGSGGE
PSESGSSGSSESGSSEGGPGESPGGSSGSESGSGGEPSESGSSGESPGGSSGSESGSGG
EPSESGSS |
| AE864 | 213 | GSPAGSPTSTEEGTSESATPESGPGTSTEPSEGSAPGSPAGSPTSTEEGTSTEPSEGSAP
GTSTEPSEGSAPGTSESATPESGPGSEPATSGSETPGSEPATSGSETPGSPAGSPTSTEE
GTSESATPESGPGTSTEPSEGSAPGTSTEPSEGSAPGSPAGSPTSTEEGTSTEPSEGSAP
GTSTEPSEGSAPGTSESATPESGPGTSTEPSEGSAPGTSESATPESGPGSEPATSGSETP
GTSTEPSEGSAPGTSTEPSEGSAPGTSESATPESGPGTSESATPESGPGSPAGSPTSTEE
GTSESATPESGPGSEPATSGSETPGTSESATPESGPGTSTEPSEGSAPGTSTEPSEGSAP
GTSTEPSEGSAPGTSTEPSEGSAPGTSTEPSEGSAPGTSTEPSEGSAPGSPAGSPTSTEE
GTSTEPSEGSAPGTSESATPESGPGSEPATSGSETPGTSESATPESGPGSEPATSGSETP
GTSESATPESGPGTSTEPSEGSAPGTSESATPESGPGSPAGSPTSTEEGSPAGSPTSTEE
GSPAGSPTSTEEGTSESATPESGPGTSTEPSEGSAPGTSESATPESGPGSEPATSGSETP
GTSESATPESGPGSEPATSGSETPGTSESATPESGPGTSTEPSEGSAPGSPAGSPTSTEE
GTSESATPESGPGSEPATSGSETPGTSESATPESGPGSPAGSPTSTEEGSPAGSPTSTEE
GTSTEPSEGSAPGTSESATPESGPGTSESATPESGPGTSESATPESGPGSEPATSGSETP
GSEPATSGSETPGSPAGSPTSTEEGTSTEPSEGSAPGTSTEPSEGSAPGSEPATSGSETP
GTSESATPESGPGTSTEPSEGSAP |
| AF864 | 214 | GSTSESPSGTAPGTSPSGESSTAPGSTSESPSGTAPGSTSESPSGTAPGTSTPESGSASP
GSTSTPESGSASPGSTSESPSGTAPGSTSESPSGTAPGTSPSGESSTAPGSTSESPSGTAP
GTSPSGESSTAPGTSPSGESSTAPGSTSSTAESPGPGTSPSGESSTAPGTSPSGESSTAP
GSTSSTAESPGPGTSTPESGSASPGTSTPESGSASPGSTSESPSGTAPGSTSESPSGTAP
GTSTPESGSASPGSTSSTAESPGPGTSTPESGSASPGSTSESPSGTAPGTSPSGESSTAP
GSTSSTAESPGPGTSPSGESSTAPGTSTPESGSASPGSTSSTAESPGPGSTSSTAESPGP
GSTSSTAESPGPGSTSSTAESPGPGTSPSGESSTAPGSTSESPSGTAPGSTSESPSGTAP
GTSTPESGPXXXGASASGAPSTXXXXSESPSGTAPGSTSESPSGTAPGSTSESPSGTA
PGSTSESPSGTAPGSTSESPSGTAPGSTSESPSGTAPGTSTPESGSASPGTSPSGESSTA
PGTSPSGESSTAPGSTSSTAESPGPGTSPSGESSTAPGTSTPESGSASPGSTSESPSGTA
PGSTSESPSGTAPGTSPSGESSTAPGSTSESPSGTAPGTSTPESGSASPGTSTPESGSAS
PGSTSESPSGTAPGTSTPESGSASPGSTSSTAESPGPGSTSESPSGTAPGSTSESPSGTA
PGSTSESPSGTAPGSTSSTAESPGPGTSPSGESSTAPGTSTPESGSASPGTSPSGESSTA
PGTSPSGESSTAPGTSPSGESSTAPGSTSSTAESPGPGTSPSGESSTA
PGSSPSASTGTGPGSSTPSGATGSPGSSTPSGATGSP |
| AG864 | 215 | GASPGTSSTGSPGSSPSASTGTGPGSSPSASTGTGPGTPGSGTASSSPGSSTPSGATGS
PGSSPSASTGTGPGASPGTSSTGSPGTPGSGTASSSPGSSTPSGATGSPGTPGSGTASS
SPGASPGTSSTGSPGASPGTSSTGSPGTPGSGTASSSPGSSTPSGATGSPGASPGTSST
GSPGTPGSGTASSSPGSSTPSGATGSPGSSPSASTGTGPGSSPSASTGTGPGSSTPSGA
TGSPGSSTPSGATGSPGASPGTSSTGSPGASPGTSSTGSPGASPGTSSTGSPGTPGSGT
ASSSPGASPGTSSTGSPGASPGTSSTGSPGASPGTSSTGSPGSSPSASTGTGPGTPGSG
TASSSPGASPGTSSTGSPGASPGTSSTGSPGASPGTSSTGSPGSSTPSGATGSPGSSTPS
GATGSPGASPGTSSTGSPGTPGSGTASSSPGSSTPSGATGSPGSSTPSGATGSPGSSTP
SGATGSPGSSPSASTGTGPGASPGTSSTGSPGASPGTSSTGSPGTPGSGTASSSPGASP
GTSSTGSPGASPGTSSTGSPGASPGTSSTGSPGASPGTSSTGSPGTPGSGTASSSPGSS
TPSGATGSPGTPGSGTASSSPGSSTPSGATGSPGTPGSGTASSSPGSSTPSGATGSPGS
STPSGATGSPGSSPSASTGTGPGSSPSASTGTGPGASPGTSSTGSPGTPGSGTASSSPG
SSTPSGATGSPGSSPSASTGTGPGSSPSASTGTGPGASPGTSSTGSPGASPGTSSTGSP
GSSTPSGATGSPGSSPSASTGTGPGASPGTSSTGSPGSSPSASTGTGPGTPGSGTASSS
PGSSTPSGATGSPGSSTPSGATGSPGASPGTSSTGSP |
| AM875 | 216 | GTSTEPSEGSAPGSEPATSGSETPGSPAGSPTSTEEGTSSTAESPGPGTSTPESGSASP
GSTSESPSGTAPGSTSESPSGTAPGTSTPESGSASPGTSTPESGSASPGSEPATSGSETP
GTSESATPESGPGSPAGSPTSTEEGTSTEPSEGSAPGTSESATPESGPGTSTEPSEGSAP
GTSTEPSEGSAPGSPAGSPTSTEEGTSTEPSEGSAPGTSTEPSEGSAPGTSESATPESGP
GTSESATPESGPGTSTEPSEGSAPGTSTEPSEGSAPGTSESATPESGPGTSTEPSEGSAP
GSEPATSGSETPGSPAGSPTSTEEGSSTPSGATGSPGTPGSGTASSSPGSSTPSGATGS
PGTSTEPSEGSAPGTSTEPSEGSAPGSEPATSGSETPGSPAGSPTSTEEGSPAGSPTSTE
EGTSTEPSEGSAPGASASGAPSTGTSESATPESGPGSPAGSPTSTEEGSPAGSPTSTE
EGSTSSTAESPGPGTSESPSGTAPGTSPSGESSTAPGTPGSGTASSSPGSSTPSGATGS
PGSSPSASTGTGPGSEPATSGSETPGTSESATPESGPGSEPATSGSETPGTSSTAESPG
PGTSSTAESPGPGTSPSGESSTAPGSEPATSGSETPGSEPATSGSETPGTSTEPSEGSA
PGTSSTAESPGPGTSTPESGSASPGSTSESPSGTAPGTSTEPSEGSAPGTSTEPSEGSA
PGTSTEPSEGSAPGSSTPSGATGSPGSSPSASTGTGPGASPGTSSTGSPGSEPATSGSE
TPGTSESATPESGPGSPAGSPTSTEEGSSTPSGATGSPGSSPSASTGTGPGASPGTSST
GSPGTSESATPESGPGTSTEPSEGSAPGTSTEPSEGSAP |
| AE912 | 217 | MAEPAGSPTSTEEGTPGSGTASSSPGSSTPSGATGSPGASPGTSSTGSPGSPAGSPTST
EEGTSESATPESGPGTSTEPSEGSAPGSPAGSPTSTEEGTSTEPSEGSAPGTSTEPSEGS
APGTSESATPESGPGSEPATSGSETPGSEPATSGSETPGSPAGSPTSTEEGTSESATPES |

TABLE 2-continued

XTEN Polypeptides

| XTEN Name | SEQ ID NO: | Amino Acid Sequence |
|---|---|---|
| | | GPGTSTEPSEGSAPGTSTEPSEGSAPGSPAGSPTSEEGTSTEPSEGSAPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPES<br>GPGTSTEPSEGSAP |
| AM923 | 218 | MAEPAGSPTSTEEGASPGTSSTGSPGSSTPSGATGSPGSSTPSGATGSPGTSTEPSEGS<br>APGSEPATSGSETPGSPAGSPTSTEEGSTSSTAESPGPGTSTPESGSASPGSTSESPSGT<br>APGSTSESPSGTAPGTSTPESGSASPGTSTPESGSASPGSEPATSGSETPGTSESATPES<br>GPGSPAGSPTSTEEGTSTEPSEGSAPGTSESATPESGPGTSTEPSEGSAPGTSTEPSEGS<br>APGSPAGSPTSTEEGTSTEPSEGSAPGTSTEPSEGSAPGTSESATPESGPGTSESATPES<br>GPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGS<br>APGTSTEPSEGSAPGSEPATSGSETPGSPAGSPTSTEEGSPAGSPTSTEEGTSTEPSEGS<br>APGASASGAPSTGGTSESATPESGPGSPAGSPTSTEEGSPAGSPTSTEEGSTSSTAESP<br>GPGSTSESPSGTAPGTSPSGESSTAPGTPGSGTASSSPGSSTPSGATGSPGSSPSASTGT<br>GPGSEPATSGSETPGTSESATPESGPGSEPATSGSETPGSTSSTAESPGPGTSSTAESP<br>GPGTSPSGESSTAPGSEPATSGSETPGSEPATSGSETPGTSTEPSEGSAPGSTSSTAESP<br>GPGTSTPESGSASPGSTSESPSGTAPGTSTEPSEGSAPGTSTEPSEGSAPGTSTEPSEGS<br>APGSSTPSGATGSPGSSPSASTGTGPGASPGTSSTGSPGSEPATSGSETPGTSESATPE<br>SGPGSPAGSPTSTEEGSSTPSGATGSPGSSPSASTGTGPGASPGTSSTGSPGTSESATP<br>ESGPGTSTEPSEGSAPGTSTEPSEGSAP |
| AM1296 | 219 | GTSTEPSEGSAPGSEPATSGSETPGSPAGSPTSTEEGSTSSTAESPGPGTSTPESGSASP<br>GSTSESPSGTAPGSTSESPSGTAPGTSTPESGSASPGTSTPESGSASPGSEPATSGSETP<br>GTSESATPESGPGSPAGSPTSTEEGTSTEPSEGSAPGTSESATPESGPGTSTEPSEGSAP<br>GTSTEPSEGSAPGSPAGSPTSTEEGTSTEPSEGSAPGTSTEPSEGSAPGTSESATPESGP<br>GTSESATPESGPGTSTEPSEGSAPGTSTEPSEGSAPGTSESATPESGPGTSTEPSEGSAP<br>GSEPATSGSETPGSPAGSPTSTEEGSSTPSGATGSPGTPGSGTASSSPGSSTPSGATGS<br>PGTSTEPSEGSAPGTSTEPSEGSAPGSEPATSGSETPGSPAGSPTSTEEGSPAGSPTSTE<br>EGTSTEPSEGSAPGPEPTGPAPSGGSEPATSGSETPGTSESATPESGPGSPAGSPTSTEE<br>GTSESATPESGPGSPAGSPTSTEEGSPAGSPTSTEEGTSESATPESGPGSPAGSPTSTEE<br>GSPAGSPTSTEEGSTSSTAESPGPGSTSESPSGTAPGTSPSGESSTAPGTSTSESPSGTAP<br>GSTSESPSGTAPGTSPSGESSTAPGTSTEPSEGSAPGTSESATPESGPGTSESATPESGP<br>GSEPATSGSETPGTSESATPESGPGTSESATPESGPGTSTEPSEGSAPGTSESATPESGP<br>GTSTEPSEGSAPGTSPSGESSTAPGTSPSGESSTAPGTSPSGESSTAPGTSTEPSEGSAP<br>GSPAGSPTSTEEGTSTEPSEGSAPGSSPSASTGTGPGSSTPSGATGSPGSSTPSGATGS<br>PGSSTPSGATGSPGSSTPSGATGSPGASPGTSSTGSPGASASGAPSTGGTSPSGESSTA<br>PGSTSSTAESPGPGTSPSGESSTAPGTSESATPESGPGTSTEPSEGSAPGTSTEPSEGSA<br>PGSSPSASTGTGPGSSTPSGATGSPGASPGTSSTGSPGTSTPESGSASPGTSPSGESSTA<br>PGTSPSGESSTAPGTSESATPESGPGSEPATSGSETPGTSTEPSEGSAPGSTSESPSGTA<br>PGSTSESPSGTAPGTSTPESGSASPGSPAGSPTSTEEGTSESATPESGPGTSTEPSEGSA<br>PGSPAGSPTSTEEGTSESATPESGPGSEPATSGSETPGSSTPSGATGSPGASPGTSSTGS<br>PGSSTPSGATGSPGTSESPSGTAPGTSPSGESSTAPGSTSSTAESPGPGSSTPSGATGS<br>PGASPGTSSTGSPGTPGSGTASSSPGSPAGSPTSTEEGSPAGSPTSTEEGTSTEPSEGSAP |
| BC 864 | 220 | GTSTEPSEPGSAGTSTEPSEPGSAGSEPATSGTEPSGSGASEPTSTEPGSEPATSGTEPS<br>GSEPATSGTEPSGSEPATSGTEPSGSGASEPTSTEPGTSTEPSEPGSAGSEPATSGTEPS<br>GTSTEPSEPGSAGSEPATSGTEPSGSEPATSGTEPSGTSTEPSEPGSAGTSTEPSEPGSA<br>GSEPATSGTEPSGSEPATSGTEPSGTSEPSTSEPGAGSGASEPTSTEPGTSEPSTSEPGA<br>GSEPATSGTEPSGSEPATSGTEPSGTSTEPSEPGSAGTSTEPSEPGSAGSGASEPTSTEP<br>GSEPATSGTEPSGSEPATSGTEPSGSEPATSGTEPSGSEPATSGTEPSGTSTEPSEPGSA<br>GSEPATSGTEPSGSGASEPTSTEPGTSTEPSEPGSAGSEPATSGTEPSGSGASEPTSTEP<br>GTSTEPSEPGSAGSGASEPTSTEPGSEPATSGTEPSGSEPATSGTEPSGSEPATSGTEPS<br>GSGASEPTSTEPGTSTEPSEPGSAGSEPATSGTEPSGSGASEPTSTEPGTSTEPSEPGSA<br>GSEPATSGTEPSGTSTEPSEPGSAGSEPATSGTEPSGTSTEPSEPGSAGTSTEPSEPGSA<br>GTSTEPSEPGSAGTSTEPSEPGSAGTSTEPSEPGSAGTSTEPSEPGSAGTSEPSTSEPGA<br>GSGASEPTSTEPGTSTEPSEPGSAGTSTEPSEPGSAGTSTEPSEPGSAGSEPATSGTEPS<br>GSGASEPTSTEPGSEPATSGTEPSGSEPATSGTEPSGSEPATSGTEPSGSEPATSGTEPS<br>GTSEPSTSEPGAGSEPATSGTEPSGSGASEPTSTEPGTSTEPSEPGSAGSEPATSGTEPS<br>GSGASEPTSTEPGTSTEPSEPGSA |
| BD864 | 221 | GSETATSGSETAGTSESATSESGAGSTAGSETSTEAGTSESATSESGAGSETATSGSE<br>TAGSETATSGSETAGTSTEASEGSASGTSTEASEGSASGTSESATSESGAGSETATSG<br>SETAGTSTEASEGSASGSTAGSETSTEAGTSESATSESGAGTSESATSESGAGSETAT<br>SGSETAGTSESATSESGAGTSTEASEGSASGSETATSGSETAGSETATSGSETAGTST<br>EASEGSASGSTAGSETSTEAGTSESATSESGAGTSTEASEGSASGSETATSGSETAGS |

TABLE 2-continued

XTEN Polypeptides

| XTEN Name | SEQ ID NO: | Amino Acid Sequence |
|---|---|---|
| | | TAGSETSTEAGSTAGSETSTEAGSETATSGSETAGTSESATSESGAGTSESATSESGA
GSETATSGSETAGTSESATSESGAGTSESATSESGAGSETATSGSETAGSETATSGSE
TAGTSTEASEGSASGSTAGSETSTEAGSETATSGSETAGTSESATSESGAGSTAGSET
STEAGSTAGSETSTEAGSTAGSETSTEAGTSTEASEGSASGSTAGSETSTEAGSTAGS
ETSTEAGTSTEASEGSASGSTAGSETSTEAGSETATSGSETAGTSTEASEGSASGTSE
SATSESGAGSETATSGSETAGTSESATSESGAGTSESATSESGAGSETATSGSETAGT
SESATSESGAGSETATSGSETAGTSTEASEGSASGTSTEASEGSASGSTAGSETSTEA
GSTAGSETSTEAGSETATSGSETAGTSESATSESGAGTSESATSESGAGSETATSGSE
TAGSETATSGSETAGSETATSGSETAGTSTEASEGSASGTSESATSESGAGSETATSG
SETAGSETATSGSETAGTSESATSESGAGTSESATSESGAGSETATSGSETA |

4. Net Charge

In other cases, the XTEN polypeptides can have an unstructured characteristic imparted by incorporation of amino acid residues with a net charge and/or reducing the proportion of hydrophobic amino acids in the XTEN sequence. The overall net charge and net charge density may be controlled by modifying the content of charged amino acids in the XTEN sequences. In some cases, the net charge density of the XTEN of the compositions may be above +0.1 or below −0.1 charges/residue. In other cases, the net charge of a XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, the XTEN sequences can be designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a high net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. Accordingly, in one embodiment the invention provides XTEN in which the XTEN sequences contain about 8, 10, 15, 20, 25, or even about 30% glutamic acid. The XTEN of the compositions of the present invention generally have no or a low content of positively charged amino acids. In some cases the XTEN may have less than about 10% amino acid residues with a positive charge, or less than about 7%, or less than about 5%, or less than about 2% amino acid residues with a positive charge. However, the invention contemplates constructs where a limited number of amino acids with a positive charge, such as lysine, may be incorporated into XTEN to permit conjugation between the epsilon amine of the lysine and a reactive group on a peptide, a linker bridge, or a reactive group on a drug or small molecule to be conjugated to the XTEN backbone. In the foregoing, a fusion proteins can be constructed that comprises XTEN, a biologically active protein, plus a chemotherapeutic agent useful in the treatment of metabolic diseases or disorders, wherein the maximum number of molecules of the agent incorporated into the XTEN component is determined by the numbers of lysines or other amino acids with reactive side chains (e.g., cysteine) incorporated into the XTEN.

In some cases, an XTEN sequence may comprise charged residues separated by other residues such as serine or glycine, which may lead to better expression or purification behavior. Based on the net charge, XTENs of the subject compositions may have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5. In these embodiments, the XTEN incorporated into the BPX-TEN fusion protein compositions of the present invention would carry a net negative charge under physiologic conditions that may contribute to the unstructured conformation and reduced binding of the XTEN component to mammalian proteins and tissues.

As hydrophobic amino acids can impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a BPXTEN fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

5. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or triggering a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity may be achieved by designing XTEN sequences that resist antigen processing in antigen presenting cells, and/or choosing sequences that do not bind MHC receptors well. The invention provides BPXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and may also reduce the immunogenicity of the BP fusion partner in the BPXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods*, 281: 95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some cases, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 74. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about −10 (corresponding to binding constraints of $10e^{10}$ $K_d$ to $10e^{-10}$ $K_d$), and can be reduced by avoiding hydrophobic amino acids that can serve as anchor residues during peptide display on MHC, such as M, I, L, V, F. In some embodiments, an XTEN component incorporated into a BPXTEN does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In another embodiment, the inventive XTEN sequences, including those incorporated into the subject BPXTEN fusion proteins, can be rendered substantially non-immunogenic by the restriction of known proteolytic sites from the sequence of the XTEN, reducing the processing of XTEN into small peptides that can bind to MHC II receptors. In another embodiment, the XTEN sequence can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN may render the XTEN compositions, including the XTEN of the BPXTEN fusion protein compositions, substantially unable to be bound by mammalian receptors, including those of the immune system. In one embodiment, an XTEN of a BPXTEN fusion protein can have >100 nM $K_d$ binding to a mammalian receptor, or greater than 500 nM $K_d$, or greater than 1 µM $K_d$ towards a mammalian cell surface or circulating polypeptide receptor.

Additionally, the non-repetitive sequence and corresponding lack of epitopes of XTEN can limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. As a result, XTENs typically may have a much lower tendency to stimulate proliferation of B cells and thus an immune response. In one embodiment, the BPXTEN may have reduced immunogenicity as compared to the corresponding BP that is not fused. In one embodiment, the administration of up to three parenteral doses of a BPXTEN to a mammal may result in detectable anti-BPXTEN IgG at a serum dilution of 1:100 but not at a dilution of 1:1000. In another embodiment, the administration of up to three parenteral doses of an BPXTEN to a mammal may result in detectable anti-BP IgG at a serum dilution of 1:100 but not at a dilution of 1:1000. In another embodiment, the administration of up to three parenteral doses of an BPXTEN to a mammal may result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness can be that non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the BPXTEN compositions can remain in circulation for an increased period of time.

6. Increased Hydrodynamic Radius

In another aspect, the present invention provides XTEN in which the XTEN polypeptides can have a high hydrodynamic radius that confers a corresponding increased Apparent Molecular Weight to the BPXTEN fusion protein incorporating the XTEN. As detailed in Example 19, the linking of XTEN to BP sequences can result in BPXTEN compositions that can have increased hydrodynamic radii, increased Apparent Molecular Weight, and increased Apparent Molecular Weight Factor compared to a BP not linked to an XTEN. For example, in therapeutic applications in which prolonged half-life is desired, compositions in which a XTEN with a high hydrodynamic radius is incorporated into a fusion protein comprising one or more BP can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape and compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 19 demonstrate, the addition of increasing lengths of XTEN results in proportional increases in the parameters of hydrodynamic radius, Apparent Molecular Weight, and Apparent Molecular Weight Factor, permitting the tailoring of BPXTEN to desired characteristic cut-off Apparent Molecular Weights or hydrodynamic radii. Accordingly, in certain embodiments, the BPXTEN fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in an BPXTEN fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence can be selectively incorporated into a BPXTEN to create a fusion protein that will have, under physiologic conditions, an Apparent Molecular Weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN of a chosen length and sequence can be selectively linked to a BP to result in a BPXTEN fusion protein that has, under physiologic conditions, an Apparent Molecular Weight Factor of at least three, alternatively of at least four, alternatively of at least five, alternatively of at least six, alternatively of at least eight, alternatively of at least 10, alternatively of at least 15, or an Apparent Molecular Weight Factor of at least 20 or greater. In another embodiment, the BPXTEN fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein.

III). Biologically Active Proteins of the BXTEN Fusion Protein Compositions

The present invention relates in part to fusion protein compositions comprising biologically active proteins and XTEN and the uses thereof for the treatment of diseases, disorders or conditions of a subject.

In one aspect, the invention provides at least a first biologically active protein (hereinafter "BP") covalently linked to a fusion protein comprising one or more extended recombinant polypeptides ("XTEN"), resulting in an XTEN fusion protein composition (hereinafter "BPXTEN"). As described more fully below, the fusion proteins can optionally include spacer sequences that can further comprise cleavage sequences to release the BP from the fusion protein when acted on by a protease.

The term "BPXTEN", as used herein, is meant to encompass fusion polypeptides that comprise one or two payload regions each comprising a biologically active protein that mediates one or more biological or therapeutic activities and at least one other region comprising at least one XTEN polypeptide.

The BP of the subject compositions, particularly those disclosed in Tables 3-8, together with their corresponding nucleic acid and amino acid sequences, are well known in the art and descriptions and sequences are available in public databases such as Chemical Abstracts Services Databases (e.g., the CAS Registry), GenBank, The Universal Protein Resource (UniProt) and subscription provided databases such as GenSeq (e.g., Derwent). Polynucleotide sequences may be a wild type polynucleotide sequence encoding a given BP (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species; or a polynucleotide encoding a variant of the wild type protein, such as a site directed mutant or an allelic variant. It is well within the ability of the skilled artisan to use a wild-type or consensus cDNA sequence or a codon-optimized variant of a BP to create BPXTEN constructs contemplated by the invention using methods known in the art and/or in conjunction with the guidance and methods provided herein, and described more fully in the Examples.

The BP for inclusion in the BPXTEN of the invention can include any protein of biologic, therapeutic, prophylactic, or diagnostic interest or function, or that is useful for mediating a biological activity or preventing or ameliorating a disease, disorder or conditions when administered to a subject. Of particular interest are BP for which an increase in a pharmacokinetic parameter, increased solubility, increased stability, or some other enhanced pharmaceutical property is sought, or those BP for which increasing the terminal half-life would improve efficacy, safety, or result in reduce dosing frequency and/or improve patient compliance. Thus, the BPXTEN fusion protein compositions are prepared with various objectives in mind, including improving the therapeutic efficacy of the bioactive compound by, for example, increasing the in vivo exposure or the length that the BPXTEN remains within the therapeutic window when administered to a subject, compared to a BP not linked to XTEN.

A BP of the invention can be a native, full-length protein or can be a fragment or a sequence variant of a biologically active protein that retains at least a portion of the biological activity of the native protein.

In one embodiment, the BP incorporated into the subject compositions can be a recombinant polypeptide with a sequence corresponding to a protein found in nature. In another embodiment, the BP can be sequence variants, fragments, homologs, and mimetics of a natural sequence that retain at least a portion of the biological activity of the native BP. In non-limiting examples, a BP can be a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 3-8. In one embodiment, a BPXTEN fusion protein can comprise a single BP molecule linked to an XTEN (as described more fully below). In another embodiment, the BPXTEN can comprise a first BP and a second molecule of the same BP, resulting in a fusion protein comprising the two BP linked to one or more XTEN (for example, two molecules of glucagon, or two molecules of hGH).

In general, BP will exhibit a binding specificity to a given target or another desired biological characteristic when used in vivo or when utilized in an in vitro assay. For example, the BP can be an agonist, a receptor, a ligand, an antagonist, an enzyme, or a hormone. Of particular interest are BP used or known to be useful for a disease or disorder wherein the native BP have a relatively short terminal half-life and for which an enhancement of a pharmacokinetic parameter (which optionally could be released from the fusion protein by cleavage of a spacer sequence) would permit less frequent dosing or an enhanced pharmacologic effect. Also of interest are BP that have a narrow therapeutic window between the minimum effective dose or blood concentration ($C_{min}$) and the maximum tolerated dose or blood concentration ($C_{max}$). In such cases, the linking of the BP to a fusion protein comprising a select XTEN sequence(s) can result in an improvement in these properties, making them more useful as therapeutic or preventive agents compared to BP not linked to XTEN.

The BP encompassed by the inventive compositions can have utility in the treatment in various therapeutic or disease categories, including but not limited to glucose and insulin disorders, metabolic disorders, cardiovascular diseases, coagulation/bleeding disorders, growth disorders or conditions, tumorigenic conditions, inflammatory conditions, autoimmune conditions, etc.

(a) Glucose-Regulating Peptides

Endocrine and obesity-related diseases or disorders have reached epidemic proportions in most developed nations, and represent a substantial and increasing health care burden in most developed nations, which include a large variety of conditions affecting the organs, tissues, and circulatory system of the body. Of particular concern are endocrine and obesity-related diseases and disorders, which. Chief amongst these is diabetes; one of the leading causes of death in the United States. Diabetes is divided into two major sub-classes-Type I, also known as juvenile diabetes, or Insulin-Dependent Diabetes Mellitus (IDDM), and Type II, also known as adult onset diabetes, or Non-Insulin-Dependent Diabetes Mellitus (NIDDM). Type I Diabetes is a form of autoimmune disease that completely or partially destroys the insulin producing cells of the pancreas in such subjects, and requires use of exogenous insulin during their lifetime. Even in well-managed subjects, episodic complications can occur, some of which are life-threatening.

In Type II diabetics, rising blood glucose levels after meals do not properly stimulate insulin production by the pancreas. Additionally, peripheral tissues are generally resistant to the effects of insulin, and such subjects often have higher than normal plasma insulin levels (hyperinsulinemia) as the body attempts to overcome its insulin resistance. In advanced disease states insulin secretion is also impaired.

Insulin resistance and hyperinsulinemia have also been linked with two other metabolic disorders that pose considerable health risks: impaired glucose tolerance and metabolic obesity. Impaired glucose tolerance is characterized by normal glucose levels before eating, with a tendency toward elevated levels (hyperglycemia) following a meal. These individuals are considered to be at higher risk for diabetes and coronary artery disease. Obesity is also a risk factor for the group of conditions called insulin resistance syndrome, or "Syndrome X," as is hypertension, coronary artery disease (arteriosclerosis), and lactic acidosis, as well as related disease states. The pathogenesis of obesity is believed to be multifactorial but an underlying problem is that in the obese, nutrient availability and energy expenditure are not in balance until there is excess adipose tissue. Other related diseases or disorders include, but are not limited to, gestational diabetes, juvenile diabetes, obesity, excessive appetite, insufficient satiety, metabolic disorder, glucagonomas, retinal neurodegenerative processes, and the "honeymoon period" of Type I diabetes.

Dyslipidemia is a frequent occurrence among diabetics; typically characterized by elevated plasma triglycerides, low HDL (high density lipoprotein) cholesterol, normal to elevated levels of LDL (low density lipoprotein) cholesterol and increased levels of small dense, LDL particles in the blood. Dyslipidemia is a main contributor to an increased incidence of coronary events and deaths among diabetic subjects.

Most metabolic processes in glucose homeostatis and insulin response are regulated by multiple peptides and hormones, and many such peptides and hormones, as well as analogues thereof, have found utility in the treatment of metabolic diseases and disorders. Many of these peptides tend to be highly homologous to each other, even when they possess opposite biological functions. Glucose-increasing peptides are exemplified by the peptide hormone glucagon, while glucose-lowering peptides include exendin-4, glucagon-like peptide 1, and amylin. However, the use of therapeutic peptides and/or hormones, even when augmented by the use of small molecule drugs, has met with limited success in the management of such diseases and disorders. In particular, dose optimization is important for drugs and biologics used in the treatment of metabolic diseases, especially those with a narrow therapeutic window. Hormones in general, and peptides involved in glucose homeostasis often have a narrow therapeutic window. The narrow therapeutic window, coupled with the fact that such hormones and peptides typically have a short half-life, which necessitates frequent dosing in order to achieve clinical benefit, results in difficulties in the management of such patients. While chemical modifications to a therapeutic protein, such as pegylation, can modify its in vivo clearance rate and subsequent serum half-life, it requires additional manufacturing steps and results in a heterogeneous final product. In addition, unacceptable side effects from chronic administration have been reported. Alternatively, genetic modification by fusion of an Fc domain to the therapeutic protein or peptide increases the size of the therapeutic protein, reducing the rate of clearance through the kidney, and promotes recycling from lysosomes by the FcRn receptor. Unfortunately, the Fc domain does not fold efficiently during recombinant expression and tends to form insoluble precipitates known as inclusion bodies. These inclusion bodies must be solubilized and functional protein must be renatured; a time-consuming, inefficient, and expensive process.

Thus, one aspect of the present invention is the incorporation of peptides involved in glucose homoestasis, insulin resistance and obesity (collectively, "glucose regulating peptides") in BPXTEN fusion proteins to create compositions with utility in the treatment of glucose, insulin, and obesity disorders, disease and related conditions. Glucose regulating peptides can include any protein of biologic, therapeutic, or prophylactic interest or function that is useful for preventing, treating, mediating, or ameliorating a disease, disorder or condition of glucose homeostasis or insulin resistance or obesity. Suitable glucose-regulating peptides that can be linked to the XTEN to create BPXTEN include all biologically active polypeptides that increase glucose-dependent secretion of insulin by pancreatic beta-cells or potentiate the action of insulin. Glucose-regulating peptides can also include all biologically active polypeptides that stimulate pro-insulin gene transcription in the pancreatic beta-cells. Furthermore, glucose-regulating peptides can also include all biologically active polypeptides that slow down gastric emptying time and reduce food intake. Glucose-regulating peptides can also include all biologically active polypeptides that inhibit glucagon release from the alpha cells of the Islets of Langerhans. Table 3 provides a non-limiting list of sequences of glucose regulating peptides that are encompassed by the BPXTEN fusion proteins of the invention. Glucose regulating peptides of the inventive BPXTEN compositions can be a peptide that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 3.

TABLE 3

Glucose regulating peptides and corresponding amino acid sequences

| Name of Protein (Synonym) | SEQ ID NO: | Sequence |
|---|---|---|
| Adrenomedullin (ADM) | 1 | YRQSMNNFQGLRSFGCRFGTCTVQKLAHQIYQFTDKDKDNVAPRSKISPQGY |
| Amylin, rat | 2 | KCNTATCATQRLANFLVRSSNNLGPVLPPTNVGSNTY |
| Amylin, human | 3 | KCNTATCATQRLANFLVHSSNNFGAILSSTNVGSNTY |
| Calcitonin (hCT) | 4 | CGNLSTCMLGTYTQDFNKFHTFPQTAIGVGAP |
| Calcitonin, salmon | 5 | CSNLSTCVLGKLSQELHKLQTYPRTNTGSGTP |
| Calcitonin gene related peptide (h-CGRP α) | 6 | ACDTATCVTHRLAGLLSRSGGVVKNMVPTNVGSKAF |
| Calcitonin gene related peptide (h-CGRP β) | 7 | ACNTATCVTHRLAGLLSRSGGMVKSNFVPTNVGSKAF |
| cholecystokinin (CCK) | 8 | MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS |
| CCK-33 | 9 | KAPSGRMSIVKNLQNLDPSHRISDRDYMGWMDF |
| CCK-8 | 10 | DYMGWMDF |
| Exendin-3 | 11 | HSDGTFTSDLSKQMEEEAVRLFIEWLKNGGPSSGAPPPS |
| Exendin-4 | 12 | HGEGTFTSDLSKQMEEEAVR LFIEWLKNGGPSSGAPPPS |
| FGF-19 | 13 | MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK |
| FGF-21 | 14 | MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS |
| Gastrin | 15 | QLGPQGPPHLVADPSKKQGPWLEEEEEAYGWMDF |
| Gastrin-17 | 16 | DPSKKQGPWLEEEEAYGWMDF |

TABLE 3-continued

Glucose regulating peptides and corresponding amino acid sequences

| Name of Protein (Synonym) | SEQ ID NO: | Sequence |
|---|---|---|
| Gastric inhibitory polypeptide (GIP) | 17 | YAEGTFISDYSIAMDKIHQQDFVNWLLAQKGKKNDWKHNITQ |
| Ghrelin | 18 | GSSFLSPEHQRVQQRKESKKPPAKLQPR |
| Glucagon | 19 | HSQGTFTSDYSKYLDSRRAQDFVQWLMNT |
| Glucagon-like peptide-1 (hGLP-1)(GLP-1; 1-37) | 20 | HDEFERHAEGTFTSDVSSTLEGQAALEFIAWLVKGRG |
| GLP-1 (7-36), human | 21 | HAEGTFTSDVSSYLEGQAALEFIAWLVKGR |
| GLP-1 (7-37), human | 22 | HAEGTFTSDVSSTLEGQAALEFIAWLVKGRG |
| GLP-1, frog | 23 | HAEGTYTNDVTEYLEEKAAKEFIEWLIKGKPKKIRYS |
| Glucagon-like peptide 2 (GLP-2), human | 24 | HADGSFSDEMNTILDNLAARDFINWLIETKITD |
| GLP-2, frog | 25 | HAEGTFTNDMTNYLEEKAAKEFVGWLIKGRP-OH |
| IGF-1 | 26 | GPETLCGAELVDALQFVCGDRGFYFNKPTGYGSSSRRAPQTGIVDECC FRSCDLRRLEMYCAPLKPAKSA |
| IGF-2 | 27 | AYRPSETLCGGELVDTLQFVCGDRGFYFSRPASRVSRRSRGIVEECCFR SCDLALLETYCATPAKSE |
| INGAP peptide (islet neogenesis-associated protein) | 28 | EESQKKLPSSRITCPQGSVAYGSYCYSLILIPQTWSNAELSCQMHFSGH LAFLLSTGEITFVSSLVKNSLTAYQYIWIGLHDPSHGTLPNGSGWKWSS SNVLTFYNWERNPSIAADRGYCAVLSQKSGFQKWRDFNCENELPYICK FKV |
| Intermedin (AFP-6) | 29 | TQAQLLRVGCVLGTCQVQNLSHRLWQLMGPAGRQDSAPVDPSSPHSY |
| Leptin, human | 30 | VPIQKVQDDTKTLIKTIVTRINDISHTQSVSSKQKVTGLDFIPGLHPILTL SKMDQTLAVYQQILTSMPSRNVIQISNDLENLRDLLHVLAFSKSCHLP WASGLETLDSLGGVLEASGYSTEVVALSRLQGSLQDMLWQLDLSPGC |
| Neuromedin (U-8) porcine | 31 | YFLFRPRN |
| Neuromedin (U-9) | 32 | GYFLFRPRN |
| neuromedin (U25) human) | 33 | FRVDEEFQSPFASQSRGYFLFRPRN |
| Neuromedin (U25) pig | 34 | FKVDEEFQGPIVSQNRRYFLFRPRN |
| Neuromedin S, human | 35 | ILQRGSGTAAVDFTKKDHTATWGRPFFLFRPRN |
| Neuromedin U, rat | 36 | YKVNEYQGPVAPSGGFFLFRPRN |
| oxyntomodulin (OXM) | 37 | HSQGTFTSDYSKYLDSRRAQDFVQWLMNTKRNRNNIA |
| Peptide YY (PYY) | 38 | YPIKPEAPGEDASPEELNRYYASLRHYLNLVTRQRY |
| Pramlintide | 39 | KCNTATCATNRLANFLVHSSNNFGPILPPTNVGSNTY-NH2 |
| Urocortin (Ucn-1) | 40 | DNPSLSIDLTFHLLRTLLELARTQSQRERAEQNRIIFDSV |
| Urocortin (Ucn-2) | 41 | IVLSLDVPIGLLQILLEQARARAAREQATTNARILARVGHC |
| Urocortin (Ucn-3) | 42 | FTLSLDVPTNIMNLLFNIAKAKNLRAQAAANAHLMAQI |

"Adrenomedullin" or "ADM" means the human adrenomedulin peptide hormone and species and sequence variants thereof having at least a portion of the biological activity of mature ADM. ADM is generated from a 185 amino acid preprohormone through consecutive enzymatic cleavage and amidation, resulting in a 52 amino acid bioactive peptide with a measured plasma half-life of 22 min. ADM-containing fusion proteins of the invention may find particular use in diabetes for stimulatory effects on insulin secretion from islet cells for glucose regulation or in subjects with sustained hypotension. The complete genomic infrastructure for human AM has been reported (Ishimitsu, et al., Biochem. Biophys.

Res. Commun 203:631-639 (1994)), and analogs of ADM peptides have been cloned, as described in U.S. Pat. No. 6,320,022. "Amylin" means the human peptide hormone referred to as amylin, pramlintide, and species variations thereof, as described in U.S. Pat. No. 5,234,906, having at least a portion of the biological activity of mature amylin.

Amylin is a 37-amino acid polypeptide hormone co-secreted with insulin by pancreatic beta cells in response to nutrient intake (Koda et al., Lancet 339:1179-1180. 1992), and has been reported to modulate several key pathways of carbohydrate metabolism, including incorporation of glucose into glycogen. Amylin-containing fusion proteins of the invention may find particular use in diabetes and obesity for regulating gastric emptying, suppressing glucagon secretion and food intake, thereby affecting the rate of glucose appearance in the circulation. Thus, the fusion proteins may complement the action of insulin, which regulates the rate of glucose disappearance from the circulation and its uptake by peripheral tissues. Amylin analogues have been cloned, as described in U.S. Pat. Nos. 5,686,411 and 7,271,238. Amylin mimetics can be created that retain biologic activity. For example, pramlintide has the sequence KCNTATCATNRLANFLVH-SSNNFGPILPPTNVGSNTY (SEQ ID NO: 43), wherein amino acids from the rat amylin sequence are substituted for amino acids in the human amylin sequence. In one embodiment, the invention contemplates fusion proteins comprising amylin mimetics of the sequence (SEQ ID NO: 44)
KCNTATCATX$_1$RLANFLVHSSNNFGX$_2$ILX$_2$X$_2$TNVGSNTY wherein $X_1$ is independently N or Q and $X_2$ is independently S, P or G. In one embodiment, the amylin mimetic incorporated into a BPXTEN can have the sequence KCNTATCAT-NRLANFLVHSSNNFGGILGGTNVGSNTY (SEQ ID NO: 45). In another embodiment, wherein the amylin mimetic is used at the C-terminus of the BPXTEN, the mimetic can have the sequence KCNTATCATNRLANFLVHSSNNFGGILG-GTNVGSNTY(NH2) (SEQ ID NO: 46).

"Calcitonin" (CT) means the human calcitonin protein and species and sequence variants thereof, including salmon calcitonin ("sCT"), having at least a portion of the biological activity of mature CT. CT is a 32 amino acid peptide cleaved from a larger prohormone of the thyroid that appears to function in the nervous and vascular systems, but has also been reported to be a potent hormonal mediator of the satiety reflex. CT is named for its secretion in response to induced hypercalcemia and its rapid hypocalcemic effect. It is produced in and secreted from neuroendocrine cells in the thyroid termed C cells. CT has effects on the osteoclast, and the inhibition of osteoclast functions by CT results in a decrease in bone resorption. In vitro effects of CT include the rapid loss of ruffled borders and decreased release of lysosomal enzymes. A major function of CT(1-32) is to combat acute hypercalcemia in emergency situations and/or protect the skeleton during periods of "calcium stress" such as growth, pregnancy, and lactation. (Reviewed in Becker, JCEM, 89(4): 1512-1525 (2004) and Sexton, Current Medicinal Chemistry 6: 1067-1093 (1999)). Calcitonin-containing fusion proteins of the invention may find particular use for the treatment of osteoporosis and as a therapy for Paget's disease of bone. Synthetic calcitonin peptides have been created, as described in U.S. Pat. Nos. 5,175,146 and 5,364,840.

"Calcitonin gene related peptide" or "CGRP" means the human CGRP peptide and species and sequence variants thereof having at least a portion of the biological activity of mature CGRP. Calcitonin gene related peptide is a member of the calcitonin family of peptides, which in humans exists in two forms, α-CGRP (a 37 amino acid peptide) and β-CGRP. CGRP has 43-46% sequence identity with human amylin. CGRP-containing fusion proteins of the invention may find particular use in decreasing morbidity associated with diabetes, ameliorating hyperglycemia and insulin deficiency, inhibition of lymphocyte infiltration into the islets, and protection of beta cells against autoimmune destruction. Methods for making synthetic and recombinant CGRP are described in U.S. Pat. No. 5,374,618.

"Cholecystokinin" or "CCK" means the human CCK peptide and species and sequence variants thereof having at least a portion of the biological activity of mature CCK. CCK-58 is the mature sequence, while the CCK-33 amino acid sequence first identified in humans is the major circulating form of the peptide. The CCK family also includes an 8-amino acid in vivo C-terminal fragment ("CCK-8"), pentagastrin or CCK-5 being the C-terminal peptide CCK(29-33), and CCK-4 being the C-terminal tetrapeptide CCK(30-33). CCK is a peptide hormone of the gastrointestinal system responsible for stimulating the digestion of fat and protein. CCK-33 and CCK-8-containing fusion proteins of the invention may find particular use in reducing the increase in circulating glucose after meal ingestion and potentiating the increase in circulating insulin. Analogues of CCK-8 have been prepared, as described in U.S. Pat. No. 5,631,230.

"Exendin-3" means a glucose regulating peptide isolated from *Heloderma horridum* and sequence variants thereof having at least a portion of the biological activity of mature exendin-3. Exendin-3 amide is a specific exendin receptor antagonist from that mediates an increase in pancreatic cAMP, and release of insulin and amylase. Exendin-3-containing fusion proteins of the invention may find particular use in the treatment of diabetes and insulin resistance disorders. The sequence and methods for its assay are described in U.S. Pat. No. 5,424,286.

"Exendin-4" means a glucose regulating peptide found in the saliva of the Gila-monster *Heloderma suspectum*, as well as species and sequence variants thereof, and includes the native 39 amino acid sequence His-Gly-Glu-Gly-Thr-Phe-Thr-Ser-Asp-Leu-Ser-Lys-Gln-Met-Glu-Glu-Glu-Ala-Val-Arg-Leu-Phe-Ile-Glu-Trp-Leu-Lys-Asn-Gly-Gly-Pro-Ser-Ser-Gly-Ala-Pro-Pro-Pro-Ser (SEQ ID NO: 47) and homologous sequences and peptide mimetics, and variants thereof; natural sequences, such as from primates and non-natural having at least a portion of the biological activity of mature exendin-4. Exendin-4 is an incretin polypeptide hormone that decreases blood glucose, promotes insulin secretion, slows gastric emptying and improves satiety, providing a marked improvement in postprandial hyperglycemia. The exendins have some sequence similarity to members of the glucagon-like peptide family, with the highest identity being to GLP-1 (Goke, et al., J. Biol. Chem., 268:19650-55 (1993)). A variety of homologous sequences can be functionally equivalent to native exendin-4 and GLP-1. Conservation of GLP-1 sequences from different species are presented in Regulatory Peptides 2001 98 p. 1-12. Table 4 shows the sequences from a wide variety of species, while Table 5 shows a list of synthetic GLP-1 analogs; all of which are contemplated for use in the BPXTEN described herein. Exendin-4 binds at GLP-1 receptors on insulin-secreting βTC1 cells, and also stimulates somatostatin release and inhibits gastrin release in isolated stomachs (Goke, et al., *J. Biol. Chem.* 268:19650-55, 1993). As a mimetic of GLP-1, exendin-4 displays a similar broad range of biological activities, yet has a longer half-life than GLP-1, with a mean terminal half-life of 2.4 h. Exenatide is a synthetic version of exendin-4, marketed as Byetta. However, due to its short half-life, exenatide is currently dosed twice daily, limiting its utility. Exendin-4-containing fusion proteins of the invention may find particular use in the treatment of diabetes and insulin resistance disorders.

'Fibroblast growth factor 21', or "FGF-21" means the human protein encoded by the FGF21 gene, or species and sequence variants thereof having at least a portion of the biological activity of mature FGF21. FGF-21 stimulates glucose uptake in adipocytes but not in other cell types; the effect is additive to the activity of insulin. FGF-21 injection in ob/ob mice results in an increase in Glut 1 in adipose tissue. FGF21 also protects animals from diet-induced obesity when over expressed in transgenic mice and lowers blood glucose and triglyceride levels when administered to diabetic rodents (Kharitonenkov A, et al., (2005). "FGF-21 as a novel metabolic regulator". J. Clin. Invest. 115: 1627-35). FGF-21-containing fusion proteins of the invention may find particular use in treatment of diabetes, including causing increased energy expenditure, fat utilization and lipid excretion. FGF-21 has been cloned, as disclosed in U.S. Pat. No. 6,716,626.

"FGF-19", or "fibroblast growth factor 19" means the human protein encoded by the FGF19 gene, or species and sequence variants thereof having at least a portion of the biological activity of mature FGF-19. FGF-19 is a protein member of the fibroblast growth factor (FGF) family. FGF family members possess broad mitogenic and cell survival activities, and are involved in a variety of biological processes. FGF-19 increases liver expression of the leptin receptor, metabolic rate, stimulates glucose uptake in adipocytes, and leads to loss of weight in an obese mouse model (Fu, L, et al. FGF-19-containing fusion proteins of the invention may find particular use in increasing metabolic rate and reversal of dietary and leptin-deficient diabetes. FGF-19 has been cloned and expressed, as described in US Patent Application No. 20020042367.

"Gastrin" means the human gastrin peptide, truncated versions, and species and sequence variants thereof having at least a portion of the biological activity of mature gastrin. Gastrin is a linear peptide hormone produced by G cells of the duodenum and in the pyloric antrum of the stomach and is secreted into the bloodstream. Gastrin is found primarily in three forms: gastrin-34 ("big gastrin"); gastrin-17 ("little gastrin"); and gastrin-14 ("minigastrin"). It shares sequence homology with CCK. Gastrin-containing fusion proteins of the invention may find particular use in the treatment of obesity and diabetes for glucose regulation. Gastrin has been synthesized, as described in U.S. Pat. No. 5,843,446.

"Ghrelin" means the human hormone that induces satiation, or species and sequence variants thereof, including the native, processed 27 or 28 amino acid sequence and homologous sequences. Ghrelin is produced mainly by P/D1 cells lining the fundus of the human stomach and epsilon cells of the pancreas that stimulates hunger, and is considered the counterpart hormone to leptin. Ghrelin levels increase before meals and decrease after meals, and can result in increased food intake and increase fat mass by an action exerted at the level of the hypothalamus. Ghrelin also stimulates the release of growth hormone. Ghrelin is acylated at a serine residue by n-octanoic acid; this acylation is essential for binding to the GHS1a receptor and for the GH-releasing capacity of ghrelin. Ghrelin-containing fusion proteins of the invention may find particular use as agonists; e.g., to selectively stimulate motility of the GI tract in gastrointestinal motility disorder, to accelerate gastric emptying, or to stimulate the release of growth hormone. Ghrelin analogs with sequence substitutions or truncated variants, such as described in U.S. Pat. No. 7,385,026, may find particular use as fusion partners to XTEN for use as antagonists for improved glucose homeostasis, treatment of insulin resistance and treatment of obesity. The isolation and characterization of ghrelin has been reported (Kojima M, et al., Ghrelin is a growth-hormone-releasing acylated peptide from stomach. Nature. 1999; 402 (6762):656-660.) and synthetic analogs have been prepared by peptide synthesis, as described in U.S. Pat. No. 6,967,237.

"Glucagon" means the human glucagon glucose regulating peptide, or species and sequence variants thereof, including the native 29 amino acid sequence and homologous sequences; natural, such as from primates, and non-natural sequence variants having at least a portion of the biological activity of mature glucagon. The term "glucagon" as used herein also includes peptide mimetics of glucagon. Native glucagon is produced by the pancreas, released when blood glucose levels start to fall too low, causing the liver to convert stored glycogen into glucose and release it into the bloodstream. While the action of glucagon is opposite that of insulin, which signals the body's cells to take in glucose from the blood, glucagon also stimulates the release of insulin, so that newly-available glucose in the bloodstream can be taken up and used by insulin-dependent tissues. Glucagon-containing fusion proteins of the invention may find particular use in increasing blood glucose levels in individuals with extant hepatic glycogen stores and maintaining glucose homeostasis in diabetes. Glucagon has been cloned, as disclosed in U.S. Pat. No. 4,826,763.

"GLP-1" means human glucagon like peptide-1 and sequence variants thereof having at least a portion of the biological activity of mature GLP-1. The term "GLP-1" includes human GLP-1(1-37), GLP-1(7-37), and GLP-1(7-36)amide. GLP-1 stimulates insulin secretion, but only during periods of hyperglycemia. The safety of GLP-1 compared to insulin is enhanced by this property and by the observation that the amount of insulin secreted is proportional to the magnitude of the hyperglycemia. The biological half-life of GLP-1(7-37)OH is a mere 3 to 5 minutes (U.S. Pat. No. 5,118,666). GLP-1-containing fusion proteins of the invention may find particular use in the treatment of diabetes and insulin-resistance disorders for glucose regulation. GLP-1 has been cloned and derivatives prepared, as described in U.S. Pat. No. 5,118,666. Non-limited examples of GLP-1 sequences from a wide variety of species are shown in Table 4, while Table 5 shows the sequences of a number of synthetic GLP-1 analogs; all of which are contemplated for use in the BPXTEN compositions described herein.

TABLE 4

Naturally GLP-1 Homologs

| Gene Name | SEQ ID NO: | Sequence |
|---|---|---|
| GLP-1 [frog] | 48 | HAEGTYTNDVTEYLEEKAAKEFIEWLIKGKPKKIRYS |
| GLP-1a [Xenopus laevis] | 49 | HAEGTFTSDVTQQLDEKAAKEFIDWLINGGPSKEIIS |

TABLE 4-continued

Naturally GLP-1 Homologs

| Gene Name | SEQ ID NO: | Sequence |
|---|---|---|
| GLP-1b [Xenopus laevis] | 50 | HAEGTYTNDVTEYLEEKAAKEFIIEWLIKGKPK |
| GLP-1c [Xenopus laevis] | 51 | HAEGTFTNDMTNYLEEKAAKEFVGWLIKGRPK |
| Gastric Inhibitory Polypeptide [Mus musculus] | 52 | HAEGTFISDYSIAMDKIRQQDFVNWLL |
| Glucose-dependent insulinotropic polypeptide [Equus caballus] | 53 | HAEGTFISDYSIAMDKIRQQDFVNWLL |
| Glucagon-like peptide [Petromyzon marinus] | 54 | HADGTFTNDMTSYLDAKAARDFVSWLARSDKS |
| Glucagon-like peptide [Anguilla rostrata] | 55 | HAEGTYTSDVSSYLQDQAAKEFVSWLKTGR |
| Glucagon-like peptide [Anguilla anguilla] | 56 | HAEGTYTSDVSSYLQDQAAKEFVSWLKTGR |
| Glucagon-like peptide [Hydrolagus colliei] | 57 | HADGIYTSDVASLTDYLKSKRFVESLSNYNKRQNDRRM |
| Glucagon-like peptide [Amia calva] | 58 | YADAPYISDVYSYLQDQVAKKWLKSGQDRRE |
| GLUC_ICTPU/38-65 | 59 | HADGTYTSDVSSYLQEQAAKDFITWLKS |
| GLUCL_ANGRO/1-28 | 60 | HAEGTYTSDVSSYLQDQAAKEFVSWLKT |
| GLUC_BOVIN/98-125 | 61 | HAEGTFTSDVSSYLEGQAAKEFIAWLVK |
| GLUC1_LOPAM/91-118 | 62 | HADGTFTSDVSSYLKDQAIKDFVDRLKA |
| GLUCL_HYDCO/1-28 | 63 | HADGIYTSDVASLTDYLKSKRFVESLSN |
| GLUC_CAVPO/53-80 | 64 | HSQGTFTSDYSKYLDSRRAQQFLKWLLN |
| GLUC_CHIBR/1-28 | 65 | HSQGTFTSDYSKHLDSRYAQEFVQWLMN |
| GLUC1_LOPAM/53-80 | 66 | HSEGTFSNDYSKYLEDRKAQEFVRWLMN |
| GLUC_HYDCO/1-28 | 67 | HTDGIFSSDYSKYLDNRRTKDFVQWLLS |
| GLUC_CALMI/1-28 | 68 | HSEGTFSSDYSKYLDSRRAKDFVQWLMS |
| GIP_BOVIN/1-28 | 69 | YAEGTFISDYSIAMDKIRQQDFVNWLLA |
| VIP_MELGA/89-116 | 70 | HADGIFTTVYSHLLAKLAVKRYLHSLIR |
| PACA_CHICK/131-158 | 71 | HIDGIFTDSYSRYRKQMAVKKYLAAVLG |
| VIP_CAVPO/45-72 | 72 | HSDALFTDTYTRLRKQMAMKKYLNSVLN |
| VIP_DIDMA/1-28 | 73 | HSDAVFTDSYTRLLKQMAMRKYLDSILN |
| EXE1_HELSU/1-28 | 74 | HSDATFTAEYSKLLAKLALQKYLESILG |
| SLIB_CAPHI/1-28 | 75 | YADAIFTNSYRKVLGQLSARKLLQDIMN |
| SLIB_RAT/31-58 | 76 | HADAIFTSSYRRILGQLYARKLLHEIMN |
| SLIB_MOUSE/31-58 | 77 | HVDAIFTTNYRKLLSQLYARKVIQDIMN |
| PACA_HUMAN/83-110 | 78 | VAHGILNEAYRKVLDQLSAGKHLQSLVA |
| PACA_SHEEP/83-110 | 79 | VAHGILDKAYRKVLDQLSARRYLQTLMA |
| PACA_ONCNE/82-109 | 80 | HADGMFNKAYRKALGQLSARKYLHSLMA |
| GLUC_BOVIN/146-173 | 81 | HADGSFSDEMNTVLDSLATRDFINWLLQ |
| SECR_CANFA/1-27 | 82 | HSDGTFTSELSRLRESARLQRLLQGLV |

TABLE 4-continued

Naturally GLP-1 Homologs

| Gene Name | SEQ ID NO: | Sequence |
|---|---|---|
| SECR_CHICK/1-27 | 83 | HSDGLFTSEYSKMRGNAQVQKFIQNLM |
| EXE3_HELHO/48-75 | 84 | HSDGTFTSDLSKQMEEEAVRLFIEWLKN |

GLP native sequences may be described by several sequence motifs, which are presented below. Letters in brackets represent acceptable amino acids at each sequence position: [HVY] [AGISTV] [DEHQ] [AG] [ILMPSTV] [FLY] [DINST] [ADEKNST] [ADENSTV] [LMVY] [ANRSTY] [EHIKNQRST] [AHILMQVY] [LMRT] [ADEGKQS] [ADEGKNQSY] [AEIKLMQR] [AKQRSVY] [AILMQSTV] [GKQR] [DEKLQR] [FHLVWY] [ILV] [ADEGHIKNQRST] [ADEGNRSTW] [GILVW] [AIKLMQSV] [ADGIKNQRST] [GKRSY]. In addition, synthetic analogs of GLP-1 can be useful as fusion partners to XTEN to create BPXTEN with biological activity useful in treatment of glucose-related disorders. Further sequences homologous to Exendin-4 or GLP-1 may be found by standard homology searching techniques.

TABLE 5

GLP-1 synthetic analogs

| SEQ ID NO: | Sequence |
|---|---|
| 85 | HAEGTFTSDVSSYLEGQAAREFIAWLVKGRG |
| 86 | HAEGTFTSDVSSYLEGQAAKEFIAWLVRGRG |
| 87 | HAEGTFTSDVSSYLEGQAAKEFIAWLVKGKG |
| 88 | HAEGTFTSDVSSYLEGQAAREFIAWLVRGKG |
| 89 | HAEGTFTSDVSSYLEGQAAREFIAWLVRGKGR |
| 90 | HAEGTFTSDVSSYLEGQAAREFIAWLVRGRGRK |
| 91 | HAEGTFTSDVSSYLEGQAAREFIAWLVRGRGRRK |
| 92 | HAEGTFTSDVSSYLEGQAAREFIAWLVKGKG |
| 93 | HAEGTFTSDVSSYLEGQAAKEFIAWLVRGKG |
| 94 | HAEGTFTSDVSSYLEGQAAREFIAWLVKGRGRK |
| 95 | HAEGTFTSDVSSYLEGQAAKEFIAWLVRGRGRRK |
| 96 | HAEGTFTSDVSSYLEGQAAREFIAWLVRGKGRK |
| 97 | HAEGTFTSDVSSYLEGQAAREFIAWLVRGKGRRK |
| 98 | HGEGTFTSDVSSYLEGQAAREFIAWLVKGRG |
| 99 | HGEGTFTSDVSSYLEGQAAKEFIAWLVRGRG |
| 100 | HGEGTFTSDVSSYLEGQAAKEFIAWLVKGKG |
| 101 | HGEGTFTSDVSSYLEGQAAREFIAWLVRGKG |
| 102 | HGEGTFTSDVSSYLEGQAAREFIAWLVRGRGRK |
| 103 | HGEGTFTSDVSSYLEGQAAREFIAWLVRGRGRRK |
| 104 | HGEGTFTSDVSSYLEGQAAREFIAWLVKGKG |
| 105 | HGEGTFTSDVSSYLEGQAAKEFIAWLVRGKG |
| 106 | HGEGTFTSDVSSYLEGQAAREFIAWLVKGRGRK |
| 107 | HGEGTFTSDVSSYLEGQAAKEFIAWLVRGRGRRK |
| 108 | HGEGTFTSDVSSYLEGQAAREFIAWLVRGKGRK |
| 109 | HGEGTFTSDVSSYLEGQAAREFIAWLVRGKGRRK |
| 110 | HAEGTFTSDVSSYLEGQAAREFIAWLVRGRGK |
| 111 | HAEGTFTSDVSSYLEGQAAREFIAWLVRGRGRK |
| 112 | HAEGTFTSDVSSYLEGQAAREFIAWLVRGRGRRK |
| 113 | HAEGTFTSDVSSYLEGQAAREFIAWLVRGRGRREK |
| 114 | HAEGTFTSDVSSYLEGQAAREFIAWLVRGRGRREFK |
| 115 | HAEGTFTSDVSSYLEGQAAREFIAWLVRGRGRREFPK |
| 116 | HAEGTFTSDVSSYLEGQAAREFIAWLVRGRGRREFPEK |
| 117 | HAEGTFTSDVSSYLEGQAAREFIAWLVRGRGRREFPEEK |
| 118 | HDEFERHAEGTFTSDVSSYLEGQAAREFIAWLVRGRGK |
| 119 | HDEFERHAEGTFTSDVSSYLEGQAAREFIAWLVRGRGRK |
| 120 | HDEFERHAEGTFTSDVSSYLEGQAAREFIAWLVRGRGRRK |
| 121 | HDEFERHAEGTFTSDVSSYLEGQAAREFIAWLVRGRGRREK |
| 122 | HDEFERHAEGTFTSDVSSYLEGQAAREFIAWLVRGRGRREFK |
| 123 | HDEFERHAEGTFTSDVSSYLEGQAAREFIAWLVRGRGRREFPK |
| 124 | HDEFERHAEGTFTSDVSSYLEGQAAREFIAWLVRGRGRREFPEK |
| 125 | HDEFERHAEGTFTSDVSSYLEGQAAREFIAWLVRGRGRREFPEEK |
| 126 | DEFERHAEGTFTSDVSSYLEGQAAREFIAWLVRGRGRK |
| 127 | DEFERHAEGTFTSDVSSYLEGQAAREFIAWLVRGRGRRK |
| 128 | DEFERHAEGTFTSDVSSYLEGQAAREFIAWLVRGRGRREK |
| 129 | DEFERHAEGTFTSDVSSYLEGQAAREFIAWLVRGRGRREFK |
| 130 | DEFERHAEGTFTSDVSSYLEGQAAREFIAWLVRGRGRREFPK |
| 131 | DEFERHAEGTFTSDVSSYLEGQAAREFIAWLVRGRGRREFPEK |
| 132 | DEFERHAEGTFTSDVSSYLEGQAAREFIAWLVRGRGRREFPEEK |
| 133 | EFERHAEGTFTSDVSSYLEGQAAREFIAWLVRGRGK |
| 134 | EFERHAEGTFTSDVSSYLEGQAAREFIAWLVRGRGRK |
| 135 | EFERHAEGTFTSDVSSYLEGQAAREFIAWLVRGRGRRK |
| 136 | EFERHAEGTFTSDVSSYLEGQAAREFIAWLVRGRGRREK |

TABLE 5-continued

GLP-1 synthetic analogs

| SEQ ID NO: | Sequence |
|---|---|
| 137 | EFERHAEGTFTSDVSSYLEGQAAREFIAWLVRGRGRREFK |
| 138 | EFERHAEGTFTSDVSSYLEGQAAREFIAWLVRGRGRREFPK |
| 139 | EFERHAEGTFTSDVSSYLEGQAAREFIAWLVRGRGRREFPEK |
| 140 | EFERHAEGTFTSDVSSYLEGQAAREFIAWLVRGRGRREFPEEK |
| 141 | FERHAEGTFTSDVSSYLEGQAAREFIAWLVRGRGK |
| 142 | FERHAEGTFTSDVSSYLEGQAAREFIAWLVRGRGRK |
| 143 | FERHAEGTFTSDVSSYLEGQAAREFIAWLVRGRGRRK |
| 144 | FERHAEGTFTSDVSSYLEGQAAREFIAWLVRGRGRREK |
| 145 | FERHAEGTFTSDVSSYLEGQAAREFIAWLVRGRGRREFK |
| 146 | FERHAEGTFTSDVSSYLEGQAAREFIAWLVRGRGRREFPK |
| 147 | FERHAEGTFTSDVSSYLEGQAAREFIAWLVRGRGRREFPEK |
| 148 | FERHAEGTFTSDVSSYLEGQAAREFIAWLVRGRGRREFPEEK |
| 149 | ERHAEGTFTSDVSSYLEGQAAREFIAWLVRGRGK |
| 150 | ERHAEGTFTSDVSSYLEGQAAREFIAWLVRGRGRK |
| 151 | ERHAEGTFTSDVSSYLEGQAAREFIAWLVRGRGRRK |
| 152 | ERHAEGTFTSDVSSYLEGQAAREFIAWLVRGRGRREK |
| 153 | ERHAEGTFTSDVSSYLEGQAAREFIAWLVRGRGRREFK |
| 154 | ERHAEGTFTSDVSSYLEGQAAREFIAWLVRGRGRREFPK |
| 155 | ERHAEGTFTSDVSSYLEGQAAREFIAWLVRGRGRREFPEK |
| 156 | ERHAEGTFTSDVSSYLEGQAAREFIAWLVRGRGRREFPEEK |
| 157 | RHAEGTFTSDVSSYLEGQAAREFIAWLVRGRGK |
| 158 | RHAEGTFTSDVSSYLEGQAAREFIAWLVRGRGRK |
| 159 | RHAEGTFTSDVSSYLEGQAAREFIAWLVRGRGRRK |
| 160 | RHAEGTFTSDVSSYLEGQAAREFIAWLVRGRGRREK |
| 161 | RHAEGTFTSDVSSYLEGQAAREFIAWLVRGRGRREFK |
| 162 | RHAEGTFTSDVSSYLEGQAAREFIAWLVRGRGRREFPK |
| 163 | RHAEGTFTSDVSSYLEGQAAREFIAWLVRGRGRREFPEK |
| 164 | RHAEGTFTSDVSSYLEGQAAREFIAWLVRGRGRREFPEEK |
| 165 | HDEFERHAEGTFTSDVSSYLEGQAAREFIAWLVKGRGK |
| 166 | HDEFERHAEGTFTSDVSSYLEGQAAKEFIAWLVRGRGK |
| 167 | HDEFERHAEGTFTSDVSSYLEGQAAREFIAWLVRGKGK |
| 168 | HAEGTFTSDVSSYLEGQAAREFIAWLVKGRGK |
| 169 | HAEGTFTSDVSSYLEGQAAKEFIAWLVRGRGK |
| 170 | HAEGTFTSDVSSYLEGQAAREFIAWLVRGKGK |
| 171 | HAEGTFTSDVSSYLEGQAAREFIAWLVKGRGK |
| 172 | HDEFERHAEGTFTSDVSSYLEGQAAREFIAWLVKGRGRK |
| 173 | HDEFERHAEGTFTSDVSSYLEGQAAKEFIAWLVRGRGRK |
| 174 | HDEFERHAEGTFTSDVSSYLEGQAAREFIAWLVRGKGRK |
| 175 | HAEGTFTSDVSSYLEGQAAREFIAWLVKGRGRK |
| 176 | HAEGTFTSDVSSYLEGQAAKEFIAWLVRGRGRK |
| 177 | HAEGTFTSDVSSYLEGQAAREFIAWLVRGKGRK |
| 178 | HGEGTFTSDVSSYLEGQAAREFIAWLVKGRGK |
| 179 | HGEGTFTSDVSSYLEGQAAREFIAWLVRGKGK |

"GLP-2" means human glucagon like peptide-2 and sequence variants thereof having at least a portion of the biological activity of mature GLP-2. More particularly, GLP-2 is a 33 amino acid peptide, co-secreted along with GLP-1 from intestinal endocrine cells in the small and large intestine.

"IGF-1" or "Insulin-like growth factor 1" means the human IGF-1 protein and species and sequence variants thereof having at least a portion of the biological activity of mature IGF-1. IGF-1, which was once called somatomedin C, is a polypeptide protein anabolic hormone similar in molecular structure to insulin, and that modulates the action of growth hormone. IGF-1 consists of 70 amino acids and is produced primarily by the liver as an endocrine hormone as well as in target tissues in a paracrine/autocrine fashion. IGF-1-containing fusion proteins of the invention may find particular use in the treatment of diabetes and insulin-resistance disorders for glucose regulation. IGF-1 has been cloned and expressed in *E. coli* and yeast, as described in U.S. Pat. No. 5,324,639.

"IGF-2" or "Insulin-like growth factor 2" means the human IGF-2 protein and species and sequence variants thereof having at least a portion of the biological activity of mature IGF-2. IGF-2 is a polypeptide protein hormone similar in molecular structure to insulin, with a primary role as a growth-promoting hormone during gestation. IGF-2 has been cloned, as described in Bell G I, et al. Isolation of the human insulin-like growth factor genes: insulin-like growth factor II and insulin genes are contiguous. Proc Natl Acad Sci USA. 1985. 82(19):6450-4.

"INGAP", or "islet neogenesis-associated protein", or "pancreatic beta cell growth factor" means the human INGAP peptide and species and sequence variants thereof having at least a portion of the biological activity of mature INGAP. INGAP is capable of initiating duct cell proliferation, a prerequisite for islet neogenesis. INGAP-containing fusion proteins of the invention may find particular use in the treatment or prevention of diabetes and insulin-resistance disorders. INGAP has been cloned and expressed, as described in R Rafaeloff R, et al., Cloning and sequencing of the pancreatic islet neogenesis associated protein (INGAP) gene and its expression in islet neogenesis in hamsters. J Clin Invest. 1997. 99(9): 2100-2109.

"Intermedin" or "AFP-6" means the human intermedin peptide and species and sequence variants thereof having at least a portion of the biological activity of mature intermedin. Intermedin is a ligand for the calcitonin receptor-like receptor. Intermedin treatment leads to blood pressure reduction both in normal and hypertensive subjects, as well as the suppression of gastric emptying activity, and is implicated in glucose homeostasis. Intermedin-containing fusion proteins of the invention may find particular use in the treatment of diabetes, insulin-resistance disorders, and obesity. Intermedin peptides and variants have been cloned, as described in U.S. Pat. No. 6,965,013.

"Leptin" means the naturally occurring leptin from any species, as well as biologically active D-isoforms, or fragments and sequence variants thereof. Leptin plays a key role in regulating energy intake and energy expenditure, including appetite and metabolism. Leptin-containing fusion proteins of the invention may find particular use in the treatment of diabetes for glucose regulation, insulin-resistance disorders, and obesity. Leptin is the polypeptide product of the ob gene as described in the International Patent Pub. No. WO 96/05309. Leptin has been cloned, as described in U.S. Pat. No. 7,112,659, and leptin analogs and fragments in U.S. Pat. No. 5,521,283, U.S. Pat. No. 5,532,336, PCT/US96/22308 and PCT/US96/01471.

"Neuromedin" means the neuromedin family of peptides including neuromedin U and S peptides, and sequence variants thereof. The native active human neuromedin U peptide hormone is neuromedin-U25, particularly its amide form. Of particular interest are their processed active peptide hormones and analogs, derivatives and fragments thereof. Included in the neuromedin U family are various truncated or splice variants, e.g., FLFHYSKTQKLGKSNVVEELQSP-FASQSRGYFLFRPRN (SEQ ID NO: 180). Exemplary of the neuromedin S family is human neuromedin S with the sequence ILQRGSGTAAVDFTKKDHTATWGR-PFFLFRPRN (SEQ ID NO: 181), particularly its amide form. Neuromedin fusion proteins of the invention may find particular use in treating obesity, diabetes, reducing food intake, and other related conditions and disorders as described herein. Of particular interest are neuromedin modules combined with an amylin family peptide, an exendin peptide family or a GLP I peptide family module.

"Oxyntomodulin", or "OXM" means human oxyntomodulin and species and sequence variants thereof having at least a portion of the biological activity of mature OXM. OXM is a 37 amino acid peptide produced in the colon that contains the 29 amino acid sequence of glucagon followed by an 8 amino acid carboxyterminal extension. OXM has been found to suppress appetite. OXM-containing fusion proteins of the invention may find particular use in the treatment of diabetes for glucose regulation, insulin-resistance disorders, obesity, and can be used as a weight loss treatment.

"PYY" means human peptide YY polypeptide and species and sequence variants thereof having at least a portion of the biological activity of mature PYY. PYY includes both the human full length, 36 amino acid peptide, $PYY_{1-36}$ and $PYY_{3-36}$ which have the PP fold structural motif. PYY inhibits gastric motility and increases water and electrolyte absorption in the colon. PYY may also suppress pancreatic secretion. PPY-containing fusion proteins of the invention may find particular use in the treatment of diabetes for glucose regulation, insulin-resistance disorders, and obesity. Analogs of PYY have been prepared, as described in U.S. Pat. Nos. 5,604,203, 5,574,010 and 7,166,575.

"Urocortin" means a human urocortin peptide hormone and sequence variants thereof having at least a portion of the biological activity of mature urocortin. There are three human urocortins: Ucn-1, Ucn-2 and Ucn-3. Further urocortins and analogs have been described in U.S. Pat. No. 6,214,797. Urocortins Ucn-2 and Ucn-3 have food-intake suppression, antihypertensive, cardioprotective, and inotropic properties. Ucn-2 and Ucn-3 have the ability to suppress the chronic HPA activation following a stressful stimulus such as dieting/fasting, and are specific for the CRF type 2 receptor and do not activate CRF-R1 which mediates ACTH release. BPXTEN comprising urocortin, e.g., Ucn-2 or Ucn-3, may be useful for vasodilation and thus for cardiovascular uses such as chronic heart failure. Urocortin-containing fusion proteins of the invention may also find particular use in treating or preventing conditions associated with stimulating ACTH release, hypertension due to vasodilatory effects, inflammation mediated via other than ACTH elevation, hyperthermia, appetite disorder, congestive heart failure, stress, anxiety, and psoriasis. Urocortin-containing fusion proteins may also be combined with a natriuretic peptide module, amylin family, and exendin family, or a GLP1 family module to provide an enhanced cardiovascular benefit, e.g. treating CHF, as by providing a beneficial vasodilation effect.

(b) Metabolic Disease and Cardiovascular Proteins

Metabolic and cardiovascular diseases represent a substantial health care burden in most developed nations, with cardiovascular diseases remaining the number one cause of death and disability in the United States and most European countries. Metabolic diseases and disorders include a large variety of conditions affecting the organs, tissues, and circulatory system of the body. Chief amongst these is diabetes; one of the leading causes of death in the United States, as it results in pathology and metabolic dysfunction in both the vasculature, central nervous system, major organs, and peripheral tissues. Insulin resistance and hyperinsulinemia have also been linked with two other metabolic disorders that pose considerable health risks: impaired glucose tolerance and metabolic obesity. Impaired glucose tolerance is characterized by normal glucose levels before eating, with a tendency toward elevated levels (hyperglycemia) following a meal. These individuals are considered to be at higher risk for diabetes and coronary artery disease. Obesity is also a risk factor for the group of conditions called insulin resistance syndrome, or "Syndrome X," as is hypertension, coronary artery disease (arteriosclerosis), and lactic acidosis, as well as related disease states. The pathogenesis of obesity is believed to be multifactorial but an underlying problem is that in the obese, nutrient availability and energy expenditure are not in balance until there is excess adipose tissue.

Dyslipidemia is a frequent occurrence among diabetics and subjects with cardiovascular disease; typically characterized by parameters such as elevated plasma triglycerides, low HDL (high density lipoprotein) cholesterol, normal to elevated levels of LDL (low density lipoprotein) cholesterol and increased levels of small dense, LDL particles in the blood. Dyslipidemia and hypertension is a main contributor to an increased incidence of coronary events, renal disease, and deaths among subjects with metabolic diseases like diabetes and cardiovascular disease.

Cardiovascular disease can be manifest by many disorders, symptoms and changes in clinical parameters involving the heart, vasculature and organ systems throughout the body, including aneurysms, angina, atherosclerosis, cerebrovascular accident (Stroke), cerebrovascular disease, congestive heart failure, coronary artery disease, myocardial infarction, reduced cardiac output and peripheral vascular disease, hypertension, hypotension, blood markers (e.g., C-reactive protein, BNP, and enzymes such as CPK, LDH, SGPT, SGOT), amongst others.

Most metabolic processes and many cardiovascular parameters are regulated by multiple peptides and hormones ("metabolic proteins"), and many such peptides and hormones, as well as analogues thereof, have found utility in the treatment of such diseases and disorders. However, the use of therapeutic peptides and/or hormones, even when augmented by the use of small molecule drugs, has met with limited success in the management of such diseases and disorders. In particular, dose optimization is important for drugs and biologics used in the treatment of metabolic diseases, especially those with a narrow therapeutic window. Hormones in general, and peptides involved in glucose homeostasis often have a narrow therapeutic window. The narrow therapeutic window, coupled with the fact that such hormones and peptides typically have a short half-life which necessitates frequent dosing in order to achieve clinical benefit, results in difficulties in the management of such patients. Therefore, there remains a need for therapeutics with increased efficacy and safety in the treatment of metabolic diseases.

Thus, one aspect of the present invention is the incorporation of biologically active metabolic proteins and involved in or used in the treatment of metabolic and cardiovascular diseases and disorders into BPXTEN fusion proteins to create compositions with utility in the treatment of such disorders, disease and related conditions. The metabolic proteins can include any protein of biologic, therapeutic, or prophylactic interest or function that is useful for preventing, treating, mediating, or ameliorating a metabolic or cardiovascular disease, disorder or condition. Table 6 provides a non-limiting list of such sequences of metabolic BPs that are encompassed by the BPXTEN fusion proteins of the invention. Metabolic proteins of the inventive BPXTEN compositions can be a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 6.

TABLE 6

Biologically active proteins for metabolic disorders and cardiology

| Name of Protein (Synonym) | Sequence | SEQ ID NO. |
|---|---|---|
| Anti-CD3 | See U.S. Pat. Nos. 5,885,573 and 6,491,916 | |
| IL-1ra, human full length | MEICRGLRSHLITLLLFLFHSETICRPSGRKSSKMQAFRIWDVNQKTFYLRN NQLVAGYLQGPNVNLEEKIDVVPIEPHALFLGIHGGKMCLSCVKSGDETRL QLEAVNITDLSENRKQDKRFAFIRSDSGPTTSFESAACPGWFLCTAMEADQ PVSLTNMPDEGVMVTKFYFQEDE | 1723 |
| IL-1ra, Dog | METCRCPLSYLISFLLFLPHSETACRLGKRPCRMQAFRIWDVNQKTF YLRNNQLVAGYLQGSNTKLEEKLDVVPVEPHAVFLGIHGGKLCLA CVKSGDETRLQLEAVNITDLSKNKDQDKRFTFILSDSGPTTSFESAA CPGWFLCTALEADRPVSLTNRPEEAMMVTKFYFQKE | 1724 |
| IL-1ra, Rabbit | MRPSRSTRRHLISLLLFLFHSETACRPSGKRPCRMQAFRIWDVNQKT FYLRNNQLVAGYLQGPNAKLEERIDVVPLEPQLLFLGIQRGKLCLSC VKSGDKMKLHLEAVNITDLGKNKEQDKRFTFIRSNSGPTTTFESASC PGWFLCTALEADQPVSLTNTPDDSIVVTKFYFQED | 1725 |
| IL-1ra, Rat | MEICRGPYSHLISLLLILLFRSESAGHIPAGKRPCKMQAFRIWDTNQK TFYLRNNQLIAGYLQGPNTKLEEKIDMVPIDFRNVFLGIHGGKLCLS CVKSGDDTKLQLEEVNITDLNKNKEEDKRFTFIRSETGPTTSFESLA CPGWFLCTTLEADHPVSLTNTPKEPCTVTKFYFQED | 1726 |
| IL-1ra, Mouse | MEICWGPYSHLISLLLILLFHSEAACRPSGKRPCKMQAFRIWDTNQK TFYLRNNQLIAGYLQGPNIKLEEKIDMVPIDLHSVFLGIHGGKLCLSC AKSGDDIKLQLEEVNITDLSKNKEEDKRFTFIRSEKGPTTSFESAACP GWFLCTTLEADRPVSLTNTPEEPLIVTKFYFQEDQ | 1727 |
| Anakinra | MRPSGRKSSKMQAFRIWDVNQKTFYLRNNQLVAGYLQGPNVNLEEKIDV VPIEPHALFLGIHGGKMCLSCVKSGDETRLQLEAVNITDLSENRKQDKRFA FIRSDSGPTTSFESAACPGWFLCTAMEADQPVSLTNMPDEGVMVTKFYFQE DE | 1728 |
| α-natriuretic peptide (ANP) | SLRRSSCFGGRMDRIGAQSGLGCNSFRY | 1729 |
| β-natriuretic peptide, human (BNP human) | SPKMVQGSGGFGRKMDRISSSSGLGCKVLRRH | 1730 |
| Brain natriuretic peptide, Rat; (BNP Rat) | NSKMAHSSSCFGQKIDRIGAVSRLGCDGLRLF | 1731 |
| C-type natriuretic peptide (CNP, porcine) | GLSKGCFGLKLDRIGSMSGLGC | 1732 |
| Fibroblast growth factor 2 (FGF-2) | PALPEDGGSGAFPPGHFKDPKRLYCKNGGFFLRIHPDGRVDGVREKSDPHI KLQLQAEERGVVSIKGVCANRYLAMKEDGRLLASKCVTDECFFFERLESN NYNTYRS RKYTSWYVAL KRTGQYKLGS KTGPGQKAIL FLPMSAKS | 1733 |

TABLE 6-continued

Biologically active proteins for metabolic disorders and cardiology

| Name of Protein (Synonym) | Sequence | SEQ ID NO. |
|---|---|---|
| TNF receptor (TNFR) | LPAQVAFTPYAPEPGSTCRLREYYDQTAQMCCSKCSPGQHAKVFCTKTSD TVCDSCEDSTYTQLWNWVPECLSCGSRCSSDQVETQACTREQNRICTCRPG WYCALSKQEGCRLCAPLRKCRPGFGVARPGTETSDVVCKPCAPGTFSNTTS STDICRPHQICNVVAIPGNASMDAVCTSTSPTRSMAPGAVHLPQPVSTRSQH TQPTPEPSTAPSTSFLLPMGPSPPAEGSTGD | 1734 |

"Anti-CD3" means the monoclonal antibody against the T cell surface protein CD3, species and sequence variants, and fragments thereof, including OKT3 (also called muromonab) and humanized anti-CD3 monoclonal antibody (hOKT31 (Ala-Ala))(K C Herold et al., New England Journal of Medicine 346:1692-1698. 2002) Anti-CD3 prevents T-cell activation and proliferation by binding the T-cell receptor complex present on all differentiated T cells. Anti-CD3-containing fusion proteins of the invention may find particular use to slow new-onset Type 1 diabetes, including use of the anti-CD3 as a therapeutic effector as well as a targeting moiety for a second therapeutic BP in the BPXTEN composition. The sequences for the variable region and the creation of anti-CD3 have been described in U.S. Pat. Nos. 5,885,573 and 6,491,916.

"IL-1ra" means the human IL-1 receptor antagonist protein and species and sequence variants thereof, including the sequence variant anakinra (Kineret®), having at least a portion of the biological activity of mature IL-1ra. Human IL-1ra is a mature glycoprotein of 152 amino acid residues. The inhibitory action of IL-1ra results from its binding to the type I IL-1 receptor. The protein has a native molecular weight of 25 kDa, and the molecule shows limited sequence homology to IL-1α (19%) and IL-1β (26%) Anakinra is a nonglycosylated, recombinant human IL-1ra and differs from endogenous human IL-1ra by the addition of an N-terminal methionine. A commercialized version of anakinra is marketed as Kineret®. It binds with the same avidity to IL-1 receptor as native IL-1ra and IL-1b, but does not result in receptor activation (signal transduction), an effect attributed to the presence of only one receptor binding motif on IL-1ra versus two such motifs on IL-1α and IL-1β. Anakinra has 153 amino acids and 17.3 kD in size, and has a reported half-life of approximately 4-6 hours.

Increased IL-1 production has been reported in patients with various viral, bacterial, fungal, and parasitic infections; intravascular coagulation; high-dose IL-2 therapy; solid tumors; leukemias; Alzheimer's disease; HIV-1 infection; autoimmune disorders; trauma (surgery); hemodialysis; ischemic diseases (myocardial infarction); noninfectious hepatitis; asthma; UV radiation; closed head injury; pancreatitis; peritonitis; graft-versus-host disease; transplant rejection; and in healthy subjects after strenuous exercise. There is an association of increased IL-1b production in patients with Alzheimer's disease and a possible role for IL 1 in the release of the amyloid precursor protein. IL-1 has also been associated with diseases such as type 2 diabetes, obesity, hyperglycemia, hyperinsulinemia, type 1 diabetes, insulin resistance, retinal neurodegenerative processes, disease states and conditions characterized by insulin resistance, acute myocardial infarction (AMI), acute coronary syndrome (ACS), atherosclerosis, chronic inflammatory disorders, rheumatoid arthritis, degenerative intervertebral disc disease, sarcoidosis, Crohn's disease, ulcerative colitis, gestational diabetes, excessive appetite, insufficient satiety, metabolic disorders, glucagonomas, secretory disorders of the airway, osteoporosis, central nervous system disease, restenosis, neurodegenerative disease, renal failure, congestive heart failure, nephrotic syndrome, cirrhosis, pulmonary edema, hypertension, disorders wherein the reduction of food intake is desired, irritable bowel syndrome, myocardial infarction, stroke, post-surgical catabolic changes, hibernating myocardium, diabetic cardiomyopathy, insufficient urinary sodium excretion, excessive urinary potassium concentration, conditions or disorders associated with toxic hypervolemia, polycystic ovary syndrome, respiratory distress, chronic skin ulcers, nephropathy, left ventricular systolic dysfunction, gastrointestinal diarrhea, postoperative dumping syndrome, irritable bowel syndrome, critical illness polyneuropathy (CIPN), systemic inflammatory response syndrome (SIRS), dyslipidemia, reperfusion injury following ischemia, and coronary heart disease risk factor (CHDRF) syndrome. IL-1ra-containing fusion proteins of the invention may find particular use in the treatment of any of the foregoing diseases and disorders. IL-1ra has been cloned, as described in U.S. Pat. Nos. 5,075,222 and 6,858,409.

"Natriuretic peptides" means atrial natriuretic peptide (ANP), brain natriuretic peptide (BNP or B-type natriuretic peptide) and C-type natriuretic peptide (CNP); both human and non-human species and sequence variants thereof having at least a portion of the biological activity of the mature counterpart natriuretic peptides. Alpha atrial natriuretic peptide (aANP) or (ANP) and brain natriuretic peptide (BNP) and type C natriuretic peptide (CNP) are homologous polypeptide hormones involved in the regulation of fluid and electrolyte homeostasis. Sequences of useful forms of natriuretic peptides are disclosed in U.S. Patent Publication 20010027181. Examples of ANPs include human ANP (Kangawa et al., BBRC 118:131 (1984)) or that from various species, including pig and rat ANP (Kangawa et al., BBRC 121:585 (1984)). Sequence analysis reveals that preproBNP consists of 134 residues and is cleaved to a 108-amino acid ProBNP. Cleavage of a 32-amino acid sequence from the C-terminal end of ProBNP results in human BNP (77-108), which is the circulating, physiologically active form. The 32-amino acid human BNP involves the formation of a disulfide bond (Sudoh et al., BBRC 159:1420 (1989)) and U.S. Pat. Nos. 5,114,923, 5,674,710, 5,674,710, and 5,948,761. BPXTEN-containing one or more natriuretic functions may be useful in treating hypertension, diuresis inducement, natriuresis inducement, vascular conduct dilatation or relaxation, natriuretic peptide receptors (such as NPR-A) binding, apida secretion suppression from the kidney, aldostrerone secretion suppression from the adrenal gland, treatment of cardiovascular diseases and disorders, reducing, stopping or reversing cardiac remodeling after a cardiac event or as a result of congestive heart failure, treatment of renal diseases and disorders; treatment or prevention of ischemic stroke, and treatment of asthma.

"FGF-2" or heparin-binding growth factor 2, means the human FGF-2 protein, and species and sequence variants thereof having at least a portion of the biological activity of the mature counterpart. FGF-2 had been shown to stimulate proliferation of neural stem cells differentiated into striatal-like neurons and protect striatal neurons in toxin-induced models of Huntington Disease, and also my have utility in treatment of cardiac reperfusion injury, and may have endothelial cell growth, anti-angiogenic and tumor suppressive properties, wound healing, as well as promoting fracture healing in bones. FGF-2 has been cloned, as described in Burgess, W. H. and Maciag, T., Ann. Rev. Biochem., 58:575-606 (1989); Coulier, F., et al., 1994, Prog. Growth Factor Res. 5:1; and the PCT publication WO 87/01728.

"TNF receptor" means the human receptor for TNF, and species and sequence variants thereof having at least a portion of the biological receptor activity of mature TNFR. P75 TNF Receptor molecule is the extracellular domain of p75 TNF receptor, which is from a family of structurally homologous receptors which includes the p55 TNF receptor. TNF α and TNF β (TNF ligands) compete for binding to the p55 and p75 TNF receptors. The x-ray crystal structure of the complex formed by the extracellular domain of the human p55 TNF receptor and TNF β has been determined (Banner et al. Cell 73:431, 1993, incorporated herein by reference).

(c) Coagulation Factors

In hemophilia the clotting of blood is disturbed by a lack of certain plasma blood clotting factors. Human factor IX (FIX) is a zymogen of a serine protease that is an important component of the intrinsic pathway of the blood coagulation cascade. In individuals who do not have FIX deficiency, the average half-life of FIX is short; approximately 18-24 hours. A deficiency of functional FIX, due to an X-linked disorder that occurs in about one in 30,000 males, results in hemophilia B, also known as Christmas disease. Over 100 mutations of factor IX have been described; some cause no symptoms, but many lead to a significant bleeding disorder. When untreated, hemophilia B is associated with uncontrolled bleeding into muscles, joints, and body cavities following injury, and may result in death. Previously, treatments for the disease included administration of FIX prepared from human plasma derived from donor pools, which carried attendant risks of infection with blood-borne viruses including human immunodeficiency virus (HIV) and hepatitis C virus (HCV). More recently, recombinant FIX products have become commercially available. The in vivo activity of exogenously supplied factor IX is limited both by protein half-life and inhibitors of coagulation, including antithrombin III. Factor IX compositions typically have short half-lives requiring frequent injections. Also, current FIX-based therapeutics require intravenous administration due to poor bioavailability. Thus, there is a need for factor IX compositions with extended half-life and retention of activity when administered as part of a preventive and/or therapeutic regimen for hemophilia B.

The physiological trigger of coagulation is the formation of a complex between tissue Factor (TF) and Factor VIIa (FVIIa) on the surface of TF expressing cells, which are normally located outside the vasculature. This leads to the activation of Factor IX and Factor X, ultimately generating some thrombin. In turn, thrombin activates Factor VIII and Factor IX, the so-called "intrinsic" arm of the blood coagulation cascade, thus amplifying the generation of Factor Xa, which is necessary for the generation of the full thrombin burst to achieve complete hemostasis. It was subsequently shown that by administering high concentrations of Factor VIIa, hemostasis can be achieved, bypassing the need for Factor VIIIa and Factor IXa in certain bleeding disorders. Coagulation and bleeding disorders can result in changes in such parameters as prothrombin time, partial prothrombin time, bleeding time, clotting time, platelet count, prothrombin fragment 1+2 (F1+2), thrombin-antithrombin III complex (TAT), D-dimer, incidence of bleeding episodes, erythrocyte sedimentation rate (ESR), C-reactive protein, and blood concentration of coagulation factors.

Thus, Factor VIIa (FVIIa) proteins have found utility for the treatment of bleeding episodes in hemophilia A or B patients with inhibitors to FVIII or FIX and in patients with acquired hemophilia, as well as prevention of bleeding in surgical interventions or invasive procedures in hemophilia A or B patients with inhibitors to FVIII or FIX. In addition, factor VIIa can be utilized in treatment of bleeding episodes in patients with congenital Factor VII deficiency and prevention of bleeding in surgical interventions or invasive procedures in patients with congenital FVII deficiency. However, the intravenous administration of products containing FVIIa can lead to side effects including thrombotic events, fever, and injection site reactions. In addition, the short half-life of Factor VIIa of approximately 2 hours, limits its application, and can require repeated injections every 2-4 hours to achieve hemostasis. Thus, there remains a need for factor IX and factor VIIa compositions with extended half-life and retention of activity when administered as part of a preventive and/or therapeutic regimen for hemophilia B, as well as formulations that reduce side effects and can be administered by both intravenous and subcutaneous routes.

The coagulation factors for inclusion in the BPXTEN of the invention can include proteins of biologic, therapeutic, or prophylactic interest or function that are useful for preventing, treating, mediating, or ameliorating blood coagulation disorders, diseases, or deficiencies. Suitable coagulation proteins include biologically active polypeptides that are involved in the coagulation cascade as substrates, enzymes or co-factors.

Table 7 provides a non-limiting list of sequences of coagulation factors that are encompassed by the BPXTEN fusion proteins of the invention. Coagulation factors for inclusion in the BPXTEN of the invention can be a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein sequence selected from Tables 7.

TABLE 7

| Coagulation factor polypeptide sequences | | |
|---|---|---|
| BPXTEN Name | SEQ ID NO: | Sequence |
| FIX precursor | 1735 | MQRVNMIMAESPGLITICLLGYLLSAECTVFLDHENANKILNRPKRYNSGKLEEFV QGNLERECMEEKCSFEEAREVFENTERTTEFW TABLE 7-continued Coagulation factor polypeptide sequences

| BPXTEN Name | SEQ ID NO: | Sequence |
|---|---|---|
| | | DFTRVVGGEDAKPGQFPWQVVLNGKVDAFCGGSIVNEKWIVTAAHCVETGVKIT<br>VVAGEHNIEETEHTEQKRNVIRIIPHHNYNAAINKYNHDIALLELDEPLVLNSYVTPI<br>CIADKEYTNIFLKFGSGYVSGWGRVFHKGRSALVLQYLRVPLVDRATCLRSTKFTI<br>YNNMFCAGFHEGGRDSCQGDSGGPHVTEVEGTSFLTGIISWGEECAMKGKYGIYT<br>KVSRYVNWIKEKTKLT |
| FIX Homo sapiens | 1736 | YNSGKLEEFVQGNLERECMEEKCSFEEAREVFENTERTTEFWKQYVDGDQCESNP<br>CLNGGSCKDDINSYECWCPFGFEGKNCELDVTCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDEP<br>LVLNSYVTPICIADKEYTNIFLKFGSGYVSGWGRVFHKGRSALVLQYLRVPLVDRA<br>TCLRSTKFTIYNNMFCAGFHEGGRDSCQGDSGGPHVTEVEGTSFLTGIISWGEECA<br>MKGKYGIYTKVSRYVNWIKEKTKLT |
| Sequence 4 from Patent US 20080214462 | 1737 | MQRVNMIMAESPGLITICLLGYLLSAECTVFLDHENANKILNRPKRYNSGKLEEFV<br>QGNLERECMEEKCSFEEAREVFENTERTTEFWKQYVDGDQCESNPCLNGGSCKD<br>DINSYECWCPFGFEGKNCELDVTCNIKNGRCEQFCKNSADNKVVCSCTEGYRLAE<br>NQKSCEPAVPFPCGRVSVSQTSKLTRAEAVFPDVDYVNSTEAETILDNITQSTQSFN<br>DFTRVVGGEDAKPGQFPWQVVLNGKVDAFCGGSIVNEKWIVTAAHCVETGVKIT<br>VVAGEHNIEETEHTEQKRNVIRIIPHHNFNAAINTYNHDIALLELDEPLVNSYVTPIC<br>IADKEYTNIFLKFGSGYVSGWGRVFHKGRSALVLQYLRVPLVDRATCLRSTKFTIY<br>NNMFCAGFHEGGRDSCQGDSGGPHVTEVEGTSFLTGIISWGEECAMKGKYGIYTK<br>VSRYVNWIKEKTKLT |
| Sequence 6 from Patent US 20080214462 | 1738 | MQRVNMIMAESPGLITICLLGYLLSAECTVFLDHENANKILNRPKRYNSGKLEEFV<br>QGNLERECMEEKCSFEEAREVFENTERTTEFWKQYVDGDQCESNPCLNGGSCKD<br>DINSYECWCPFGFEGKNCELDVTCNIKNGRCEQFCKNSADNKVVCSCTEGYRLAE<br>NQKSCEPAVPFPCGRVSVSQTSKLTRAEAVFPDVDYVNSTEAETILDNITQSTQSFN<br>DFTRVVGGEDAKPGQFPWQVVLNGKVDAFCGGSIVNEKWIVTAAHCVETGVKIT<br>VVAGEHNIEETEHTEQKRNVIRIIPHHNFNAAINTYNHDIALLELDEPLVNSYVTPIC<br>IADKEYTNIFLKFGSGYVSGWGRVFHKGRSALVLQYLRVPLVDRATCLRSTKFTIF<br>NNMFCAGFHEGGRDSCQGDSGGPHVTEVEGTSFLTGIISWGEECAMKGKYGIYTK<br>VSRYVNWIKEKTKLT |
| Sequence 8 from Patent US 20080214462 | 1739 | MQRVNMIMAESPGLITICLLGYLLSAECTVFLDHENANKILNRPKRYNSGKLEEFV<br>QGNLERECMEEKCSFEEAREVFENTERTTEFWKQYVDGDQCESNPCLNGGSCKD<br>DINSYECWCPFGFEGKNCELDVTCNIKNGRCEQFCKNSADNKVVCSCTEG<br>YRLAENQKSCEPAVPFPCGRVSVSQTSKLTRAEAVFPDVDYVNSTEAETILDNITQS<br>TQSFNDFTRVVGGEDAKPGQFPWQVVLNGKVDAFCGGSIVNEKWIVTAAHCVET<br>GVKITVVAGEHNIEETEHTEQKRNVIRIIPHHNFNAAINTYNHDIALLELDEPLVLNS<br>YVTPICIADKEYTNIFLKFGSGYVSGWGRVFHKGRSALVLQYLRVPLVDATCLRST<br>KFTIFNNMFCAGFHEGGRDSCQGDSGGPHVTEVEGTSFLTGIVSWGEGCAMKGKY<br>GIYTKVSRYVNWIKEKTKLT |
| Sequence 2 from Patent US 7,125,841 | 1740 | MQRVNMIMAESPSLITICLLGYLLSAECTVFLDHENANKILNRPKRYNSGKLEEFV<br>QGNLERECMEEKCSFEEPREVFENTEKITEFWKQYVDGDQCESNPCLNGGSCKDDI<br>NSYECWCPFGFEGKNCELDVTCNIKNGRCEQFCKNSADNKVVCSCTEGYRLAEN<br>QKSCEPAVPFPCGRVSVSQTSKLTRAEAVFPDVDYVNPTEAETILDNITQGTQSFND<br>FTRVVGGEDAKPGQFPWQVVLNGKVDAFCGGSIVNEKWIVTAAHCVETGVKITV<br>VAGEHNIEETEHTEQKRNVIRAIIPHHNYNAAINKYNHDIALLELDEPLVLNSYVTPI<br>CIADKEYTNIFLKFGSGYVSGWARVFHKGRSALVLQYLRVPLVDRATCLRSTKFTI<br>YNNMFCAGFHEGGRDSCQGDSGGPHVTEVEGTSFLTGIISWGEECAMKGKYGIYT<br>KVSRYVNWIKEKTKLT |
| Sequence 1 from Patent US 20080167219 | 1741 | YNSGKLEEFVQGNLERECMEEKCSFEEAREVFENTERTTEFWKQYVDGDQCESNP<br>CLNGGSCKDDINSYECWCPFGFEGKNCELDATCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDEP<br>LVLNSYVTPICIADKEYTNIFLKFGSGYVSGWGRVFHKGRSALVLQYLRVPLVDRA<br>TCLRSTKFTIYNNMFCAGFHEGGRDSCQGDSGGPHVTEVEGTSFLTGIISWGEECA<br>MKGKYGIYTKVSRYVNWIKEKTKLT |
| Sequence 2 from Patent US 20080167219 | 1742 | YNSGKLEEFVQGNLERECMEEKCSFEEAREVFENTERTTEFWKQYVDGDQCESNP<br>CLNGGSCKDDINSYECWCPFGFEGKNCELDVTCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDAP<br>LVLNSYVTPICIADKEYTNIFLKFGSGYVSGWGRVFHKGRSALVLQYLRVPLVDRA<br>TCLRSTKFTIYNNMFCAGFHEGGRDSCQGDSGGPHVTEVEGTSFLTGIISWGEECA<br>MKGKYGIYTKVSRYVNWIKEKTKLT |

TABLE 7-continued

Coagulation factor polypeptide sequences

| BPXTEN Name | SEQ ID NO: | Sequence |
|---|---|---|
| Sequence 3 from Patent US 20080167219 | 1743 | YNSGKLEEFVQGNLERECMEEKCSFEEAREVFENTERTTEFWKQYVDGDQCESNP<br>CLNGGSCKDDINSYECWCPFGFEGKNCELDATCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDAP<br>LVLNSYVTPICIADKEYTNIFLKFGSGYVSGWGRVFHKGRSALVLQYLRVPLVDRA<br>TCLRSTKFTIYNNMFCAGFHEGGRDSCQGDSGGPHVTEVEGTSFLTGIISWGEECA<br>MKGKYGIYTKVSRYVNWIKEKTKLT |
| Sequence 4 from Patent US 20080167219 | 1744 | YNSGKLEEFVQGNLERECMEEKCSFEEAREVFENTERTTEFWKQYVDGDQCESNP<br>CLNGGSCKDDINSYECWCPFGFEGKNCELDATCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDEP<br>LVLNSYVTPICIADKEYTNIFLKFGSGYVSGWGRVFHKGRSALVLQYLRVPLVDRA<br>TCLASTKFTIYNNMFCAGFHEGGRDSCQGDSGGPHVTEVEGTSFLTGIISWGEECA<br>MKGKYGIYTKVSRYVNWIKEKTKLT |
| Sequence 5 from Patent US 20080167219 | 1745 | YNSGKLEEFVQGNLERECMEEKCSFEEAREVFENTERTTEFWKQYVDGDQCESNP<br>CLNGGSCKDDINSYECWCPFGFEGKNCELDVTCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDAP<br>LVLNSYVTPICIADKEYTNIFLKFGSGYVSGWGRVFHKGRSALVLQYLRVPLVDRA<br>TCLASTKFTIYNNMFCAGFHEGGRDSCQGDSGGPHVTEVEGTSFLTGIISWGEECA<br>MKGKYGIYTKVSRYVNWIKEKTKLT |
| Sequence 6 from Patent US 20080167219 | 1746 | YNSGKLEEFVQGNLERECMEEKCSFEEAREVFENTERTTEFWKQYVDGDQCESNP<br>CLNGGSCKDDINSYECWCPFGFEGKNCELDATCNIKNGRCEQFCKNSADNKVVCS<br>CTEGYRLAENQKSCEPAVPFPCGRVSVSQTSKLTRAETVFPDVDYVNSTEAETILD<br>NITQSTQSFNDFTRVVGGEDAKPGQFPWQVVLNGKVDAFCGGSIVNEKWIVTAAH<br>CVETGVKITVVAGEHNIEETEHTEQKRNVIRIIPHHNYNAAINKYNHDIALLELDAP<br>LVLNSYVTPICIADKEYTNIFLKFGSGYVSGWGRVFHKGRSALVLQYLRVPLVDRA<br>TCLASTKFTIYNNMFCAGFHEGGRDSCQGDSGGPHVTEVEGTSFLTGIISWGEECA<br>MKGKYGIYTKVSRYVNWIKEKTKLT |
| Factor VII/VIIa | 1747 | ANAFLEELRPGSLERECKEEQCSFEEAREIFKDAERTKLFWISYSDGDQCASSPCQN<br>GGSCKDQLQSYICFCLPAFEGRNCETHKDDQLICVNENGGCEQYCSDHTGTKRSC<br>RCHEGYSLLADGVSCTPTVEYPCGKIPILEKRNASKPQGRIVGGKVCPKGECPWQV<br>LLLVNGAQLCGGTLINTIWVVSAAHCFDKIKNWRNLIAVLGEHDLSEHDGDEQSR<br>RVAQVIIPSTYVPGTTNHDIALLRLHQPVVLTDHVVPLCLPERTFSERTLAFVRFSL<br>VSGWGQLLDRGATALELMVLNVPRLMTQDCLQQSRKVGDSPNITEYMFCAGYSD<br>GSKDSCKGDSGGPHATHYRGTWYLTGIVSWGQGCATVGHFGVYTRVSQYIEWLQ<br>KLMRSEPRPGVLLRAPFP |

"Factor IX" ("FIX") includes the human Factor IX protein and species and sequence variants thereof having at least a portion of the biological receptor activity of mature Factor IX. FIX shall be any form of factor IX molecule with the typical characteristics of blood coagulation factor IX. FIX shall include FIX from plasma and any form of recombinant FIX which is capable of curing bleeding disorders in a patient; e.g., caused by deficiencies in FIX (e.g., hemophilia B). In some embodiments, the FIX peptide is a structural analog or peptide mimetic of any of the FIX peptides described herein, including the sequences of Table 7. Minor deletions, additions and/or substitutions of amino acids of the polypeptide sequence of FIX that do not abolish the biological activity of the polypeptide (i.e. reducing the activity to below 10% or even below 5% of the wild type form (=100%)) are also included in the present application as biologically active derivatives, especially those with improved specific activity (above 100% activity of the wild-type form). The FIX according to the present invention may be derived from any vertebrate, e.g. a mammal.

In some embodiments, the FIX peptide is a structural analog or peptide mimetic of any of the FIX peptides described herein, including the sequences of Table 7. Minor deletions, additions and/or substitutions of amino acids of the polypeptide sequence of FIX that do not abolish the biological activity of the polypeptide (i.e. reducing the activity to below 10% or even below 5% of the wild type form (=100%)) are also included in the present application as biologically active derivatives, especially those with improved specific activity (above 100% activity of the wild-type form). The FIX according to the present invention may be derived from any vertebrate, e.g. a mammal. In one specific example of the present invention, the FIX is human FIX. In another embodiment, the FIX is a polypeptide sequence from Table 7.

Human Factor IX (FIX) is encoded by a single-copy gene residing on the X-chromosome at q27.1. The human FIX mRNA is composed of 205 bases for the 5' untranslated region, 1383 bases for the prepro factor IX, a stop codon and 1392 bases for the 3' untranslated region. The FIX polypeptide is 55 kDa, synthesized as a prepropolypeptide chain composed of three regions: a signal peptide of 28 amino acids, a propeptide of 18 amino acids, which is required for gamma-carboxylation of glutamic acid residues, and a mature factor IX of 415 amino acids. The mature factor IX is composed of domains. The domains, in an N- to C-terminus configuration are a Gla domain, an EGF1 domain, a EGF2 domain, an activation peptide domain, and a protease (or catalytic) domain. The protease domain provides, upon activation of FIX to FIXa, the catalytic activity of FIX. Following activation, the single-chain FIX becomes a 2-chain molecule, in which the two chains are linked by a disulfide bond attaching the enzyme to the Gla domain. Activated factor VIII (FVIIIa) is the specific cofactor for the full expression of FIXa activity. As used herein "factor IX" and "FIX" are intended to encompass polypeptides that comprise the domains Gla, EGF1, EGF2, activation peptide, and protease, or synonyms of these domains known in the art.

FIX is expressed as a precursor polypeptide that requires posttranslational processing to yield active FIX. In particular, the precursor polypeptide of FIX requires gamma carboxylation of certain glutamic acid residues in the so-called gamma-carboxyglutamate domain and cleavage of propeptide. The propeptide is an 18-amino acid residue sequence N-terminal to the gamma-carboxyglutamate domain. The propeptide binds vitamin K-dependent gamma carboxylase and then is cleaved from the precursor polypeptide of FIX by an endogenous protease, most likely PACE (paired basic amino acid cleaving enzyme), also known as furin or PCSK3. Without the gamma carboxylation, the Gla domain is unable to bind calcium to assume the correct conformation necessary to anchor the protein to negatively charged phospholipid surfaces, thereby rendering Factor IX nonfunctional. Even if it is carboxylated, the Gla domain also depends on cleavage of the propeptide for proper function, since retained propeptide interferes with conformational changes of the Gla domain necessary for optimal binding to calcium and phospholipid. The resulting mature Factor IX is a single chain protein of 415 amino acid residues that contains approximately 17% carbohydrate by weight (Schmidt, A. E., et al. (2003) Trends Cardiovasc Med, 13: 39).

Mature FIX must be activated by activated Factor XI to yield Factor IXa. In the intrinsic pathway of the coagulation cascade, FIX associates with a complex of activated Factor VIII, Factor X, calcium, and phospholipid. In the complex, FIX is activated by Factor Xia. The activation of Factor IX is achieved by a two-step removal of the activation peptide (Ala 146-Arg 180) from the molecule. (Bajaj et al., "Human factor IX and factor IXa," in METHODS IN ENZYMOLOGY. 1993). The first cleavage is made at the Arg 145-Ala 146 site by either Factor Xia or Factor VIIa/tissue factor. The second, and rate limiting cleavage is made at Arg 180-Val 181. The activation removes 35 residues. Activated human Factor IX exists as a disulfide linked heterodimer of the heavy chain and light chain. Factor IXa in turn activates Factor X in concert with activated Factor VIII. Alternatively, Factors IX and X can both be activated by Factor VIIa complexed with apidated Tissue Factor, generated via the extrinsic pathway. Factor Xa then participates in the final common pathway whereby prothrombin is converted to thrombin, and thrombin, in turn converts fibrinogen to fibrin to form the clot.

In some cases, the coagulation factor is Factor IX, a sequence variant of Factor IX, or a Factor IX moiety, such as the exemplary sequences of Table 7, as well as any protein or polypeptide substantially homologous thereto whose biological properties result in the activity of Factor IX. As used herein, the term "Factor IX moiety" includes proteins modified deliberately, as for example, by site directed mutagenesis or accidentally through mutations, that result in a factor IX sequence that retain at least some factor IX activity. The term "Factor IX moiety" also includes derivatives having at least one additional amino acid at the N- or carboxy terminal ends of the protein or internal to the Factor IX moiety sequence. Non-limiting examples of Factor IX moieties include the following: Factor IX; Factor IXa; truncated versions of Factor IX; hybrid proteins, and peptide mimetics having Factor IX activity. Biologically active fragments, deletion variants, substitution variants or addition variants of any of the foregoing that maintain at least some degree of Factor IX activity or the potential for activation can also serve as a Factor IX sequence.

"Factor VII" (FVII) means the human protein, and species and sequence variants thereof having at least a portion of the biological activity of activated Factor VII. Factor VII and recombinant human FVIIa has been introduced for use in uncontrollable bleeding in hemophilia patients (with Factor VIII or IX deficiency) who have developed inhibitors against replacement coagulation factor. Factor VII can be activated by thrombin, factor IXa, factor Xa or factor XIIa to FVIIa. FVII is converted to its active form Factor VIIa by proteolysis of the single peptide bond at Arg152-Ile153 leading to the formation of two polypeptide chains, a N-terminal light chain (24 kDa) and a C-terminal heavy chain (28 kDa), which are held together by one disulfide bridge. In contrast to other vitamin K-dependent coagulation factors no activation peptide, which is cleaved off during activation of these other vitamin-K dependent coagulation factors, has been described for FVII. The Arg152-Ile153 cleavage site and some amino acids downstream show homology to the activation cleavage site of other vitamin K-dependent polypeptides. Recombinant human factor VIIa has utility in treatment of uncontrollable bleeding in hemophilia patients (with Factor VIII or IX deficiency), including those who have developed inhibitors against replacement coagulation factor. FVII shall be any form of factor VII molecule with the typical characteristics of blood coagulation factor VII. FVII shall include FVII from plasma and any form of recombinant FVII which is capable of ameliorating bleeding disorders in a patient; e.g., caused by deficiencies in FVII/FVIIa. In some embodiments, the FVII peptide is the activated form (FVIIa), a structural analog or peptide mimetic of any of the FVII peptides described herein, including sequences of Table 7. Factor VII and VIIa have been cloned, as described in U.S. Pat. No. 6,806,063 and US Patent Application No. 20080261886.

In one aspect, the invention provides monomeric BPXTEN fusion proteins of FIX comprising the full-length sequence, or active fragments, or sequence variants, or any biologically active derivative of FIX, including the FIX sequences of Table 7, covalently linked to an XTEN, to create a chimeric molecule. In some cases, the fusion proteins comprising a coagulation factor such as FIX, further comprise one or more proteolytic cleavage site sequences. In another embodiment, the fusion protein comprises a first and a second, different cleavage sequence. In an embodiment of the foregoing, the cleavage sequence(s) are selected from Table 10. In those cases where the presence of the XTEN inhibits activation of FIX to the activated form of FIX (hereinafter "FIXa") (e.g., wherein the XTEN is attached to the C-terminus of FIX), the one or more proteolytic cleavage site permits the release of the XTEN sequence when acted on by a protease, as described more fully below. In a feature of the foregoing, the intact FIX-XTEN composition serves as a pro-drug, and the release of the XTEN from the FIX-XTEN molecule by proteolysis permits the released FIX sequence to be converted to FIXa. In one embodiment, the one or more cleavage sequences can be a sequence having at least about 80% sequence identify to a sequence from Table 10, or at least about 85%, or at least about 90%, or at least about 95%, or at least about 96%, or at least about 97%, or at least about 98%, or at least about 99%, or 100% sequence identity to a sequence from Table 10.

Figure 37:
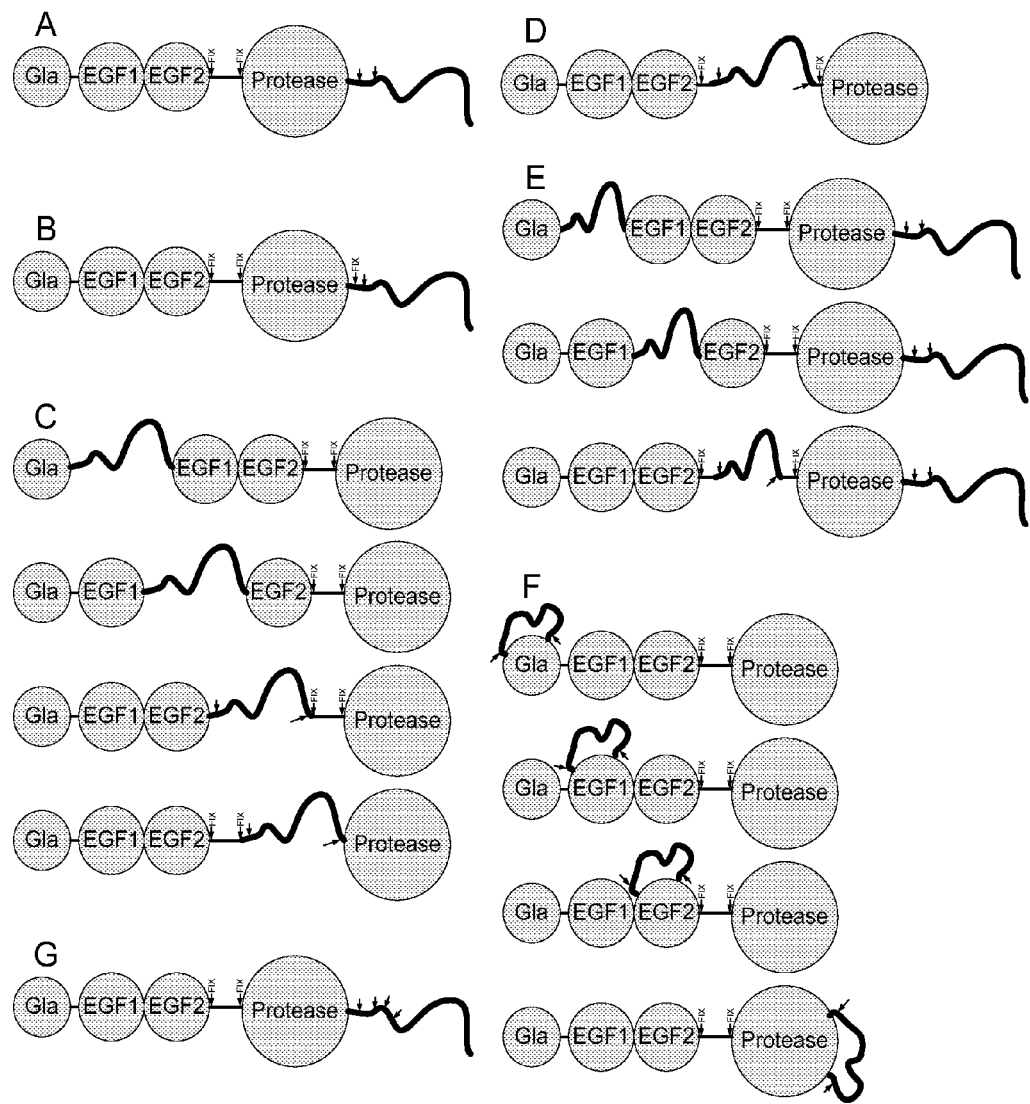
FIG. 37 illustrates several examples of FIX-XTEN configurations and associated protease cleavage sites.

FIX-XTEN fusion proteins can be designed in different configurations. In one embodiment, as illustrated in FIG. 37A, the fusion proteins comprise components in the following order (N- to C-terminus): FIX; and XTEN, wherein the XTEN may comprise a cleavage sequence internal to the XTEN sequence. In another embodiment, as illustrated in FIG. 37B, the fusion proteins comprise components in the following order (N- to C-terminus): FIX; cleavage sequence; and XTEN. In some cases, as illustrated in FIGS. 37C and 37D, the fusion proteins comprise components wherein the XTEN is located internal to the FIX polypeptide, inserted between FIX domains. In one embodiment, the N-terminus of the XTEN is linked to the C-terminus of the FIX Gla domain and the C-terminus of the XTEN is linked to the N-terminus of the EGF1 domain of FIX, resulting in an FIX-XTEN where no additional cleavage sequences are introduced, as shown in FIG. 37C. In another embodiment, the N-terminus of the XTEN is linked to the C-terminus of the FIX EGF1 domain and the C-terminus of the XTEN is linked to the N-terminus of the EGF2 domain of FIX, resulting in an FIX-XTEN where no additional cleavage sequences are introduced, as shown in FIG. 37C. In another embodiment, wherein the factor IX sequence comprises an activation peptide domain comprising a PDVDYVNSTEAETILDNITQSTQSFNDF (SEQ ID NO: 1748) sequence, the N- and C-termini of the XTEN sequence can be inserted between and linked to any two contiguous or any two discontiguous amino acids of the activation peptide domain sequence, and the XTEN optionally comprises both a first and a second cleavage sequence, which may be identical or different. In another embodiment of the foregoing, the XTEN can be inserted between the contiguous T and I amino acids of the foregoing sequence wherein the N-terminus of the XTEN is linked to the C-terminus of the T amino acid and the C-terminus of the XTEN is linked to the N-terminus of the I amino acid.

In another embodiment, as illustrated in FIG. 37E, the fusion proteins comprise two molecules of XTEN: a first located between two domains of FIX as described above, and a second XTEN wherein the N-terminus of the XTEN is linked to the C-terminus of FIX or wherein the N-terminus of the second XTEN is linked to the C-terminus of a cleavage sequence that is linked to the C-terminus of FIX.

In other cases, as illustrated in FIG. 37F, the FIX-XTEN fusion proteins comprise components wherein the XTEN is located within a sequence of a FIX domain, inserted as a part of an existing structural loop in the domain or creating a loop external to the domain structure. In one embodiment, wherein the FIX comprises an EGF2 domain wherein the EGF2 domain comprises a KNSADNK (SEQ ID NO: 1749) loop, the XTEN sequence can be inserted between the S and A amino acids of the loop sequence wherein the N-terminus of the XTEN is linked to the C-terminus of the S and the C-terminus of the XTEN is linked to the N-terminus of the A, resulting in a loop sequence with the XTEN polypeptide extending outside the globular coagulation protein, and wherein the XTEN can (optionally) comprise both a first and a second cleavage sequence, which may be identical or different. In another embodiment, the XTEN can be inserted between any two contiguous or discontiguous amino acids of the KNSADNK loop sequence. In another embodiment, wherein the FIX comprises an EGF2 domain wherein the EGF2 domain comprises a LAEN loop, the XTEN sequence can be inserted between the contiguous A and E amino acids of the LAEN loop, wherein the N-terminus of the XTEN is linked to the C-terminus of A and the C-terminus of the XTEN is linked to the N-terminus of the E, resulting in a loop sequence LA-XTEN-EN, and the XTEN can (optionally) comprise both a first and a second cleavage sequence, which may be identical or different, In another embodiment, wherein the FIX comprises a Gla domain, the XTEN can be inserted and linked between two contiguous amino acids of the Gla sequence wherein the XTEN forms a loop structure, wherein the loop structure is substantially external to the Gla structure, and the XTEN can (optionally) comprise both a first and a second cleavage sequence, which may be identical or different, In another embodiment, wherein the FIX comprises an EGF1 domain, the XTEN can be inserted and linked between two contiguous amino acids of the EGF1 sequence wherein the XTEN forms a loop structure, wherein the loop structure is substantially external to the EGF1 structure, and the XTEN can (optionally) comprise both a first and a second cleavage sequence, which may be identical or different.

In another embodiment, as illustrated in FIG. 37G, the fusion proteins comprise components in the order FIX; and XTEN, wherein the XTEN comprises multiple cleavage sequences near the N-terminus of the XTEN, preferably within the first 144 amino acid residues of the XTEN, more preferably within about the first 80 amino acids, more preferably within about the first 42 amino acids, more preferably within about the first 18 amino acids, and even more preferably within the first 12 amino acids of the N-terminus of the XTEN sequence.

In other embodiments, the FIX-XTEN can exist in the configuration (N- to C-terminal) XTEN-FIX, alternatively XTEN-FIX-XTEN, alternatively XTEN-CS-FIX, alternatively FIX-XTEN-FIX, alternatively FIX-CS-XTEN-CS-XTEN, or multimers of the foregoing.

In one embodiment, the FIX-XTEN is configured such that the FIX of the FIX-XTEN composition can be activated to FIXa by a coagulation protease without the release of some or all of an XTEN. In another embodiment, wherein FIX-XTEN comprises at least two XTEN, the FIX-XTEN is configured such that the FIX of the FIX-XTEN composition can be activated to FIXa by a coagulation protease without the release of one of the XTENs. In another embodiment, wherein the XTEN is to be released from the FIX-XTEN either prior to activation of the FIX to FIXa, or concomitant with the activation of the FIX to FIXa, the cleavage sequences are located sufficiently close to the ends of the XTEN linked to any portion of the FIX such that any remaining XTEN or cleavage sequence residues do not appreciably interfere with the activation of FIX, yet provide sufficient access to the protease to effect cleavage of the corresponding cleavage sequence. In one embodiment, wherein an XTEN is linked to the C-terminus of the FIX (as described above), the one or more cleavage sites can be located within about the first 100 amino acids of the N-terminus of the XTEN, more preferably within the first 80 amino acids, more preferably within the first 54 amino acids, more preferably within the first 42 amino acids, more preferably within the first 30 amino acids, more preferably within the first 18 amino acids, and most preferably within the first 6 amino acids of the N-terminus of the XTEN. In another embodiment, wherein an XTEN is linked internal to the FIX sequence (as described above), either between two FIX domains or within an external loop of a FIX domain or internal to a domain sequence, the XTEN can comprise two or more cleavage sequences in which at least one cleavage site can be located within about the first 100 amino acids of the N-terminus of the XTEN, within 80, within 54, within 42, within 30, within 18, or within 6 amino acids of the N-terminus and the XTEN can comprise at least a second cleavage site located within the last 100 amino acids of the C-terminus of the XTEN, within 80, within 54, within 42, within 30, within 18, or within 6 amino acids of the C-terminus of the XTEN.

In some cases, protease cleavage of the fusion protein releases the XTEN from the FIX sequence in a subject such that the FIX sequence can subsequently be activated. In other cases, protease cleavage of the fusion protein is a result of action of the proteases of the coagulation cascade, such that the XTEN is released concurrently with the processing and activation of FIX to FIXa. Thus, in a particular feature of some embodiments, the XTEN and associated cleavage site(s) of the FIX-XTEN fusion protein can be located such that the FIX sequence cannot be activated until XTEN is released from the fusion protein by proteolytic cleavage. In such embodiments, the FIX-XTEN can be used as prodrug that can be activated once it is administered to the subject. In one embodiment, the released FIX polypeptides can contain all or part of an XTEN, particularly when the FIX-XTEN comprises two XTEN sequences. Alternatively, the released FIX polypeptides can be free from the XTEN or substantially all of the XTEN.

In other embodiments, the cleavage site is used during the synthesis procedure of the fusion protein. For example, the fusion protein can further contain an affinity tag for isolation of the fusion protein after recombinant production. A protease that recognized the cleavage site in the fusion protein can remove the tag, while leaving a final product that is FIX linked to the XTEN.

Thus, the fusion protein can have a cleavage site, which can be cleaved before injection, after injection (in the blood circulation or tissues by proteases) and can be located such that the XTEN stays with the therapeutic product until it is released by an endogenous protease, either permitting the therapeutic product to be activated by the coagulation cascade, or the XTEN is released by a protease of the coagulation cascade.

In some embodiments, a fusion protein of FIX is converted from an inactive protein to an active protein (e.g., FIXa) by a site-specific protease, either in the circulation or within a body tissue or cavity. This cleavage may trigger an increase in potency of the pharmaceutically active domain (pro-drug activation) or it may enhance binding of the cleavage product to its target. So, for example, FIX-XTEN fusion proteins can be cleaved in the blood of a subject and the FIX sequence can become activated by the coagulation cascade or by another protease disclosed herein. The active form of the FIX fusion protein may or may not contain at least a fragment of XTEN. In a feature of the FIX-XTEN pro-drug embodiments, a higher dosage of the FIX-XTEN composition may be administered, compared to conventional FIX therapeutics, because the release of the FIX capable of being activated can be controlled by the selection of cleavage sequences, or varying the numbers of cleavage sites required to be cleaved before a form of FIX is released that can be activated. As those with skill in the art will appreciate, the sequence of any of the cleavage sites disclosed herein can be modified by introducing amino acid variations into the cleavage sequences in order to modify the kinetics of proteolytic cleavage, thereby affecting the kinetics of FIX release and subsequent activation.

The invention provides BPXTEN fusion proteins comprising a coagulation protein and XTEN. In some cases, the BPXTEN comprises a coagulation protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a coagulation protein selected from Table 7. In one embodiment of the foregoing, the BPXTEN further comprises an XTEN sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to an XTEN selected from Table 2. In another embodiment, the BPXTEN comprises a sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from Table 43. The invention also contemplates substitution of any FIX sequence from Table 7, any XTEN from Table 2, and any cleavage sequence from Table 10 for the respective components of Table 43, or sequences with at least 90% sequence identity to the foregoing.

In another embodiment, the BPXTEN coagulation protein is the FVII sequence of Table 7 and the XTEN is selected from AE864 and AM875. In one embodiment of the foregoing, the BPXTEN comprises, in an N- to C-terminus configuration, FVII-AE864. In another embodiment, the BPXTEN is configured, N- to C-terminus as FVII-AM875. In another embodiment, the configured BPXTEN comprises a FVII that is at least about 70%, or 80%, or 90%, or at least about 95% or greater in the activated FVIIa form. In another embodiment, the BPXTEN comprising FVII and an XTEN can further comprise a cleavage sequence, which may include a sequence selected from Table 10.

(d) Growth Hormone Proteins

"Growth Hormone" or "GH" means the human growth hormone protein and species and sequence variants thereof, and includes, but is not limited to, the 191 single-chain amino acid human sequence of GH. Thus, GH can be the native, full-length protein or can be a truncated fragment or a sequence variant that retains at least a portion of the biological activity of the native protein. Effects of GH on the tissues of the body can generally be described as anabolic. Like most other protein hormones, GH acts by interacting with a specific plasma membrane receptor, referred to as growth hormone receptor. There are two known types of human GH (hereinafter "hGH") derived from the pituitary gland: one having a molecular weight of about 22,000 daltons (22 kD hGH) and the other having a molecular weight of about 20,000 daltons (20 kD hGH). The 20 kD HGH has an amino acid sequence that corresponds to that of 22 kD hGH consisting of 191 amino acids except that 15 amino acid residues from the $32^{nd}$ to the $46^{th}$ of 22 kD hGH are missing. Some reports have shown that the 20 kD hGH has been found to exhibit lower risks and higher activity than 22 kD hGH. The invention also contemplates use of the 20 kD hGH as being appropriate for use as a biologically active polypeptide for BPXTEN compositions herein.

The invention contemplates inclusion in the BPXTEN of any GH homologous sequences, sequence fragments that are natural, such as from primates, mammals (including domestic animals), and non-natural sequence variants which retain at least a portion of the biologic activity or biological function of GH and/or that are useful for preventing, treating, mediating, or ameliorating a GH-related disease, deficiency, disorder or condition. Non-mammalian GH sequences are well-described in the literature. For example, a sequence alignment of fish GHs can be found in *Genetics and Molecular Biology* 2003 26 p. 295-300. An analysis of the evolution of avian GH sequences is presented in *Journal of Evolutionary Biology* 2006 19 p. 844-854. In addition, native sequences homologous to human GH may be found by standard homology searching techniques, such as NCBI BLAST.

In one embodiment, the GH incorporated into the subject compositions can be a recombinant polypeptide with a sequence corresponding to a protein found in nature. In another embodiment, the GH can be a sequence variant, fragment, homolog, or a mimetics of a natural sequence that retains at least a portion of the biological activity of the native GH. Table 8 provides a non-limiting list of sequences of GHs from a wide variety of mammalian species that are encompassed by the BPXTEN fusion proteins of the invention. Any of these GH sequences or homologous derivatives constructed by shuffling individual mutations between species or families may be useful for the fusion proteins of this invention. GH that can be incorporated into a BPXTEN fusion protein can include a protein that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to a protein selected from Table 8.

TABLE 8

Growth hormone amino acid sequences from animal species

| Species GH | Amino Acid Sequence | SEQ ID NO. |
|---|---|---|
| Man | FPTIPLSRLFDNAMLRAHRLHQLAFDTYQEFEEAYIPKEQKYSFLQNPQTSLCF SESIPTPSNREETQQKSNLELLRISLLLIQSWLEPVQFLRSVFANSLVYGASDSN VYDLLKDLEEGIQTLMGRLEDGSPRTGQIFKQTYSKFDTNSHNDDALLKNYG LLYCFRKDMDKVETFLRIVQCRSVEGSCGF | 1750 |
| Pig | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRAGQILKQTYDKFDTNLRSDDALLKNY GLLSCFKKDLHKAETYLRV MKCRRFVESSCAF | 1751 |
| Alpaca | FPAMPLSSLFANAVLRAQHLHQLAADTYKEFERTYIPEGQRYSIQNAQAAFCF SETIPAPTGKDEAQQRSDVELLRFSLLLIQSWLGPVQFLSRVFTNSLVFGTSDR VYEKLKDLEEGIQALMRELEDGSPRAGQILRQTYDKFDTNLRSDDALLKNYG LLSCFKKDLHKAETYLRV MKCRRFVESSCAF | 1752 |
| Camel | FPAMPLSSLFANAVLRAQHLHQLAADTYKEFERTYIPEGQRYSIQNAQAAFCF SETIPAPTGKDEAQQRSDVELLRFSLLLIQSWLGPVQFLSRVFTNSLVFGTSDR VYEKLKDLEEGIQALMRELEDGSPRAGQILRQTYDKFDTNLRSDDALLKNYG LLSCFKKDLHKAETYLRV MKCRRFVESSCAF | 1753 |
| Horse | FPAMPLSSLFANAVLRAQHLHQLAADTYKEFERAYIPEGQRYSIQNAQAAFC FSETIPAPTGKDEAQQRSDMELLRFSLLLIQSWLGPVQLLSRVFTNSLVFGTSD RVYEKLRDLEEGIQALMRELEDGSPRAGQILKQTYDKFDTNLRSDDALLKNY GLLSCFKKDLHKAETYLRV MKCRRFVESSCAF | 1754 |
| Elephant | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRPGQVLKQTYDKFDTNMRSDDALLKN YGLLSCFKKDLHKAETYLRV MKCRRFVESSCAF | 1755 |
| Red fox | FPAMPLSSLFANAVLRAQHLHQLAADTYKEFERAYIPEGQRYSIQNAQAAFC FSETIPAPTGKDEAQQRSDVELLRFSLVLIQSWLGPLQFLSRVFTNSLVFGTSD RVYEKLKDLEEGIQALMRELEDGSPRAGQILKQTYDKFDTNLRSDDALLKNY GLLSCFKKDLHKAETYLRV MKCRRFVESSCAF | 1756 |
| Dog | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRAGQILKQTYDKFDTNLRSDDALLKNY GLLSCFKKDLHKAETYLRV MKCRRFVESSCAF | 1757 |
| Cat | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRGGQILKQTYDKFDTNLRSDDALLKNY GLLSCFKKDLHKAETYLRV MKCRRFVESSCAF | 1758 |
| American mink | FPAMPLSSLFANAVLRAQHLHQLAADTYKDFERAYIPEGQRYSIQNAQAAFC FSETIPAPTGKDEAQQRSDMELLRFSLLLIQSWLGPVQFLSRVFTNSLVFGTSD RVYEKLKDLEEGIQALMRELEDGSPRAGPILKQTYDKFDTNLRSDDALLKNY GLLSCFKKDLHKAETYLRV MKCRRFVESSCAF | 1759 |
| Finback whale | FPAMPLSSLFANAVLRAQHLHQLAADTYKEFERAYIPEGQRYSIQNAQAAFC FSETIPAPTGKDEAQQRSDVELLRFSLLLIQSWLGPVQFLSRVFTNSLVFGTSD RVYEKLKDLEEGIQALMRELEDGSPRAGQILKQTYDKFDTNMRSDDALLKN YGLLSCFKKDLHKAETYLRV MKCRRFVESSCAF | 1760 |
| Dolphin | FPAMPLSSLFANAVLRAQHLHQLAADTYKEFERAYIPEGQRYSIQNTQAAFCF SETIPAPTGKDEAQQRSDVELLRFSLLLIQSWLGPVQFLSRVFTNSLVFGTSDR VYEKLKDLEEGIQALMRELEDGSPRAGQILKQTYDKFDTNMRSDDALLKNY GLLSCFKKDLHKAETYLRV MKCRRFVESSCAF | 1761 |
| Hippo | FPAMPLSSLFANAVLRAQHLHQLAADTYKEFERAYIPEGQRYSIQNTQAAFCF SETIPAPTGKDEAQQRSDVELLRFSLLLIQSWLGPVQFLSRVFTNSLVFGTSDR VYEKLKDLEEGIQALMRELEDGSPRAGQILKQTYDKFDTNMRSDDALLKNY GLLSCFKKDLHKAETYLRV MKCRRFVESSCAF | 1762 |

TABLE 8-continued

Growth hormone amino acid sequences from animal species

| Species GH | Amino Acid Sequence | SEQ ID NO. |
|---|---|---|
| Rabbit | FPAMPLSSLFANAVLRAQHLHQLAADTYKEFERAYIPEGQRYSIQNAQAAFC FSETIPAPTGKDEAQQRSDMELLRFSLLLIQSWLGPVQFLSRAFTNTLVFGTSD RVYEKLKDLEEGIQALMRELEDGSPRVGQLLKQTYDKFDTNLRGDDALLKN YGLLSCFKKDLHKAETYLRV MKCRRFVESSCVF | 1763 |
| Rat | FPAMPLSSLFANAVLRAQHLHQLAADTYKEFERAYIPEGQRYSIQNAQAAFC FSETIPAPTGKEEAQQRTDMELLRFSLLLIQSWLGPVQFLSRIFTNSLMFGTSD RVYEKLKDLEEGIQALMQELEDGSPRIGQILKQTYDKFDANMRSDDALLKNY GLLSCFKKDLHKAETYLRV MKCRRFAESSCAF | 1764 |
| Mouse | FPAMPLSSLFSNAVLRAQHLHQLAADTYKEFERAYIPEGQRYSIQNAQAAFCF SETIPAPTGKEEAQQRTDMELLRFSLLLIQSWLGPVQFLSRIFTNSLMFGTSDR VYEKLKDLEEGIQALMQELEDGSPRVGQILKQTYDKFDANMRSDDALLKNY GLLSCFKKDLHKAETYLRV MKCRRFVESSCAF | 1765 |
| Hamster | FPAMPLSSLFANAVLRAQHLHQLAADTYKEFERAYIPEGQRYSIQNAQTAFCF SETIPAPTGKEEAQQRSDMELLRFSLLLIQSWLGPVQFLSRIFTNSLMFGTSDR VYEKLKDLEEGIQALMQELEDGSPRVGQILKQTYDKFDTNMRSDDALLKNY GLLSCFKKDLHKAETYLRV MKCRRFVESSCAF | 1766 |
| Mole rat | FPAMPLSNLFANAVLRAQHLHQLAADTYKEFERAYIPEGQRYSIQNAQAAFC FSETIPAPTGKEEAQQRSDMELLRFSLLLIQSWLGPVQFLSRVFTNSLVFGTSD RVFEKLKDLEEGIQALMRELEDGSLRAGQLLKQTYDKFDTNMRSDDALLKN YGLLSCFKKDLHKAETYLRV MKCRRFVESSCAF | 1767 |
| Guinea pig | FPAMPLSSLFGNAVLRAQHLHQLAADTYKEFERTYIPEGQRYSIHNTQTAFCF SETIPAPTDKEEAQQRSDVELLHFSLLLIQSWLGPVQFLSRVFTNSLVFGTSDR VYEKLKDLEEGIQALMRELEDGTPRAGQILKQTYDKFDTNLRSNDALLKNYG LLSCFRKDLHRTETYLRV MKCRRFVESSCAF | 1768 |
| Ox | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFTNSLVFGTSDR VYEKLKDLEEGILALMRELEDGTPRAGQILKQTYDKFDTNMRSDDALLKNY GLLSCFRKDLHKTETYLRV MKCRRFGEASCAF | 1769 |
| Sheep/Goat | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFTNSLVFGTSDR VYEKLKDLEEGILALMRELEDVTPRAGQILKQTYDKFDTNMRSDDALLKNY GLLSCFRKDLHKTETYLRV MKCRRFGEASCAF | 1770 |
| Red deer | FPAMSLSGLFANAVLRAQHLHQLAADTFKEFERTYIPEGQRYSIQNTQVAFCF SETIPAPTGKNEAQQKSDLELLRISLLLIQSWLGPLQFLSRVFTNSLVFGTSDRV YEKLKDLEEGILALMRELEDGTPRAGQILKQTYDKFDTNMRSDDALLKNYGL LSCFRKDLHKTETYLRV MKCRRFGEASCAF | 1771 |
| Giraffe | AFPAMSLSGLFANAVLRAQHLHQLAADTFKEFERTYIPEGQRYSIQNTQVAFC FSETIPAPTGKNEAQQKSDLELLRISLLLIQSWLGPLQFLSRVFSNSLVFGTSDR VYEKLKDLEEGILALMRELEDGTPRAGQILKQTYDKFDTNMRSDDALLKNY GLLSCFRKDLHKTETYLRV MKCRRFGEASCAF | 1772 |
| Chevrotain-1 | FPAMSLSGLFANAVLRVQHLHQLAADTFKEFERTYIPEGQRYSIQNTQVAFCF SETIPAPTGKNEAQQKSDLELLRISLLLIQSWLGPLQFLSRVFTNSLVFGTSDRV YEKLKDLEEGILALMRELEDGPPRAGQILKQTYDKFDTNMRSDDALLKNYGL LSCFRKDLHKTETYLRV MKCRRFGEASCAF | 1773 |
| Slow loris | FPAMPLSSLFANAVLRAQHLHQLAADTYKEFERAYIPEGQRYSIQNAQAAFC FSETIPAPTGKDEAQQRSDMELLRFSLLLIQSWLGPVQLLSRVFTNSLVLGTSD RVYEKLKDLEEGIQALMRELEDGSPRVGQILKQTYDKFDTNLRSDDALLKNY GLLSCFKKDLHKAETYLRV MKCRRFVESSCAF | 1774 |
| Marmoset | FPTIPLSRLLDNAMLRAHRLHQLAFDTYQEFEEAYIPKEQKYSFLQNPQTSLCF SESIPTPASKKETQQKSNLELLRMSLLLIQSWFEPVQFLRSVFANSLLYGVSDS DVYEYLKDLEEGIQTLMGRLEDGSPRTGEIFMQTYRKFDVNSQNNDALLKNY GLLYCFRKDMDKVETFLRI VQCR-SVEGSCGF | 1775 |
| BrTailed Possum | FPAMPLSSLFANAVLRAQHLHQLVADTYKEFERTYIPEAQRHSIQSTQTAFCF SETIPAPTGKDEAQQRSDVELLRFSLLLIQSWLSPVQFLSRVFTNSLVFGTSDR VYEKLRDLEEGIQALMQELEDGSSRGGLVLKTTYDKFDTNLRSDEALLKNYG LLSCFKKDLHKAETYLRV MKCRRFVESSCAF | 1776 |

TABLE 8-continued

Growth hormone amino acid sequences from animal species

| Species GH | Amino Acid Sequence | SEQ ID NO. |
|---|---|---|
| Monkey (rhesus) | FPTIPLSRLFDNAMLRAHRLHQLAFDTYQEFEEAYIPKEQKYSFLQNPQTSLCF SESIPTPSNREETQQKSNLELLRISLLLIQSWLEPVQFLRSVFANSLVYGTSYSD VYDLLKDLEEGIQTLMGRLEDGSSRTGQIFKQTYSKFDTNSHNNDALLKNYG LLYCFRKDMDKIETFLRI VQCR-SVEGSCGF | 1777 |

IV). BPXTEN Structural Configurations and Properties

The BP of the subject compositions are not limited to native, full-length polypeptides, but also include recombinant versions as well as biologically and/or pharmacologically active variants or fragments thereof. For example, it will be appreciated that various amino acid substitutions can be made in the GP to create variants without departing from the spirit of the invention with respect to the biological activity or pharmacologic properties of the BP. Examples of conservative substitutions for amino acids in polypeptide sequences are shown in Table 9. However, in embodiments of the BPXTEN in which the sequence identity of the BP is less than 100% compared to a specific sequence disclosed herein, the invention contemplates substitution of any of the other 19 natural L-amino acids for a given amino acid residue of the given BP, which may be at any position within the sequence of the BP, including adjacent amino acid residues. If any one substitution results in an undesirable change in biological activity, then one of the alternative amino acids can be employed and the construct evaluated by the methods described herein, or using any of the techniques and guidelines for conservative and non-conservative mutations set forth, for instance, in U.S. Pat. No. 5,364,934, the contents of which is incorporated by reference in its entirety, or using methods generally known to those of skill in the art. In addition, variants can also include, for instance, polypeptides wherein one or more amino acid residues are added or deleted at the N- or C-terminus of the full-length native amino acid sequence of a BP that retains at least a portion of the biological activity of the native peptide.

TABLE 9

Exemplary conservative amino acid substitutions

| Original Residue | Exemplary Substitutions |
|---|---|
| Ala (A) | val; leu; ile |
| Arg © | lys; gin; asn |
| Asn (N) | gin; his; Iys; arg |
| Asp (D) | glu |
| Cys © | ser |
| Gln (Q) | asn |
| Glu (E) | asp |
| Gly (G) | pro |
| His (H) | asn: gin: Iys: arg |
| xIle (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr (Y) | trp: phe: thr: ser |
| Val (V) | ile; leu; met; phe; ala; norleucine |

(a) BPXTEN Fusion Protein Configurations

The invention provides BPXTEN fusion protein compositions comprising BP linked to one or more XTEN polypeptides useful for preventing, treating, mediating, or ameliorating a disease, disorder or condition related to glucose homeostasis, insulin resistance, or obesity. In some cases, the BPXTEN is a monomeric fusion protein with a BP linked to one or more XTEN polypeptides. In other cases, the BPX-TEN composition can include two BP molecules linked to one or more XTEN polypeptides. The invention contemplates BPXTEN comprising, but not limited to BP selected from Tables 3-8 (or fragments or sequence variants thereof), and XTEN selected from Table 2 or sequence variants thereof. In some cases, at least a portion of the biological activity of the respective BP is retained by the intact BPXTEN. In other cases, the BP component either becomes biologically active or has an increase in activity upon its release from the XTEN by cleavage of an optional cleavage sequence incorporated within spacer sequences into the BPXTEN, described more fully below.

In one embodiment of the BPXTEN composition, the invention provides a fusion protein of formula I:

$$(BP)\text{-}(S)_x\text{-}(XTEN) \quad \quad I$$

wherein independently for each occurrence, BP is a biologically active protein as described hereinabove; S is a spacer sequence having between 1 to about 50 amino acid residues that can optionally include a cleavage sequence (as described more fully below); x is either 0 or 1; and XTEN is an extended recombinant polypeptide as described hereinabove. The embodiment has particular utility where the BP requires a free N-terminus for desired biological activity, or where linking of the C-terminus of the BP to the fusion protein reduces biological activity and it is desired to reduce the biological activity and/or side effects of the administered BPXTEN.

In another embodiment of the BPXTEN composition, the invention provides a fusion protein of formula II (components as described above):

$$(XTEN)\text{-}(S)_x\text{-}(BP) \quad \quad II$$

wherein independently for each occurrence, BP is a biologically active protein as described hereinabove; S is a spacer sequence having between 1 to about 50 amino acid residues that can optionally include a cleavage sequence (as described more fully below): x is either 0 or 1; and XTEN is an extended recombinant polypeptide as described hereinabove. The embodiment has particular utility where the BP requires a free C-terminus for desired biological activity, or where linking of the N-terminus of the BP to the fusion protein reduces biological activity and it is desired to reduce the biological activity and/or side effects of the administered BPXTEN.

Thus, the BPXTEN having a single BP and a single XTEN can have at least the following permutations of configurations, each listed in an N- to C-terminus orientation: BP-XTEN; XTEN-BP; BP-S-XTEN; or XTEN-S-BP.

In another embodiment, the invention provides an isolated fusion protein, wherein the fusion protein is of formula III:

$$(BP)\text{-}(S)_x\text{-}(XTEN)\text{-}(S)_y\text{-}(BP)\text{-}(S)_z\text{-}(XTEN)_z \qquad III$$

wherein independently for each occurrence, BP is a biologically active protein as described hereinabove; S is a spacer sequence having between 1 to about 50 amino acid residues that can optionally include a cleavage sequence (as described more fully below); x is either 0 or 1; y is either 0 or 1; z is either 0 or 1; and XTEN is an extended recombinant polypeptide as described hereinabove.

In another embodiment, the invention provides an isolated fusion protein, wherein the fusion protein is of formula IV (components as described above):

$$(XTEN)_x\text{-}(S)_y\text{-}(BP)\text{-}(S)_z\text{-}(XTEN)\text{-}(BP) \qquad IV$$

In another embodiment, the invention provides an isolated fusion protein, wherein the fusion protein is of formula V (components as described above):

$$(BP)_x\text{-}(S)_x(BP)\text{-}(S)_y\text{-}(XTEN) \qquad V$$

In another embodiment, the invention provides an isolated fusion protein, wherein the fusion protein is of formula VI (components as described above):

$$(XTEN)\text{-}(S)\text{-}(BP)\text{-}(S)_y\text{-}(BP) \qquad VI$$

In another embodiment, the invention provides an isolated fusion protein, wherein the fusion protein is of formula VII (components as described above):

$$(XTEN)\text{-}(S)_x(BP)\text{-}(S)_y\text{-}(BP)\text{-}(XTEN) \qquad VII$$

In the foregoing embodiments of fusion proteins of formulas I-VII, administration of a therapeutically effective dose of a fusion protein of an embodiment to a subject in need thereof can result in a gain in time of at least two-fold, or at least three-fold, or at least four-fold, or at least five-fold or more spent within a therapeutic window for the fusion protein compared to the corresponding BP not linked to the XTEN of and administered at a comparable dose to a subject.

Any spacer sequence group is optional in the fusion proteins encompassed by the invention. The spacer may be provided to enhance expression of the fusion protein from a host cell or to decrease steric hindrance such that the BP component may assume its desired tertiary structure and/or interact appropriately with its target molecule. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) and proline (P). In some cases, the spacer can be polyglycines or polyalanines, or is predominately a mixture of combinations of glycine and alanine residues. The spacer polypeptide exclusive of a cleavage sequence is largely to substantially devoid of secondary structure. In one embodiment, one or both spacer sequences in a BPXTEN fusion protein composition may each further contain a cleavage sequence, which may be identical or may be different, wherein the cleavage sequence may be acted on by a protease to release the BP from the fusion protein.

In some cases, the incorporation of the cleavage sequence into the BPXTEN is designed to permit release of a BP that becomes active or more active upon its release from the XTEN. The cleavage sequences are located sufficiently close to the BP sequences, generally within 18, or within 12, or within 6, or within 2 amino acids of the BP sequence terminus, such that any remaining residues attached to the BP after cleavage do not appreciably interfere with the activity (e.g., such as binding to a receptor) of the BP, yet provide sufficient access to the protease to be able to effect cleavage of the cleavage sequence. In some embodiments, the cleavage site is a sequence that can be cleaved by a protease endogenous to the mammalian subject such that the BPXTEN can be cleaved after administration to a subject. In such cases, the BPXTEN can serve as a prodrug or a circulating depot for the BP. Examples of cleavage sites contemplated by the invention include, but are not limited to, a polypeptide sequence cleavable by a mammalian endogenous protease selected from FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases are known in the art. Exemplary cleavage sequences and cut sites within the sequences are presented in Table 10, as well as sequence variants. For example, thrombin (activated clotting factor II) acts on the sequence LTPRSLLV (SEQ ID NO: 222) [Rawlings N. D., et al. (2008) *Nucleic Acids Res.*, 36: D320], which would be cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibrinogen, which then in turn, begins clot formation. FIIa activity is tightly controlled and only occurs when coagulation is necessary for proper hemostasis. However, as coagulation is an on-going process in mammals, by incorporation of the LTPRSLLV (SEQ ID NO: 223) sequence into the BPXTEN between the BP and the XTEN, the XTEN domain would be removed from the adjoining BP concurrent with activation of either the extrinsic or intrinsic coagulation pathways when coagulation is required physiologically, thereby releasing BP over time. Similarly, incorporation of other sequences into BPXTEN that are acted upon by endogenous proteases would provide for sustained release of BP that may, in certain cases, provide a higher degree of activity for the BP from the "prodrug" form of the BPXTEN.

In some cases, only the two or three amino acids flanking both sides of the cut site (four to six amino acids total) would be incorporated into the cleavage sequence. In other cases, the known cleavage sequence can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the BP from the XTEN. Exemplary substitutions are shown in Table 10.

TABLE 10

Protease Cleavage Sequences

| Protease Acting Upon Sequence | SEQ ID NO: | Exemplary Cleavage Sequence | Minimal Cut Site* |
|---|---|---|---|
| FXIa | 224 | KLTR↓VVGG | KD/FL/T/R↓VA/VE/GT/GV |
| FXIIa | 225 | TMTR↓IVGG | NA |
| Kallikrein | 226 | SPFR↓STGG | —/—/FL/RY↓SR/RT/—/— |
| FVIIa | 227 | LQVR↓IVGG | NA |
| FIXa | 228 | PLGR↓IVGG | —/—/G/R↓—/—/—/— |
| FXa | 229 | IEGR↓TVGG | IA/E/GFP/R↓STI/VFS/—/G |
| FIIa (thrombin) | 230 | LTPR↓SLLV | —/—/PLA/R↓SAG/—/—/— |
| Elastase-2 | 231 | LGPV↓SGVP | —/—/—/VIAT↓—/—/—/— |
| Granzyme-B | 232 | VAGD↓SLEE | V/—/—/D↓—/—/—/— |
| MMP-12 | 233 | GPAG↓LGGA | G/PA/—/G↓L/—/G/—(SEQ ID NO: 241) |
| MMP-13 | 234 | GPAG↓LRGA | G/P/—/G↓L/—/GA/—(SEQ ID NO: 242) |
| MMP-17 | 235 | APLG↓LRLR | —/PS/—/—↓LQ/—/LT/— |
| MMP-20 | 236 | PALP↓LVAQ | NA |
| TEV | 237 | ENLYFQ↓G | ENLYFQ↓G/S (SEQ ID NO: 243) |
| Enterokinase | 238 | DDDK↓IVGG | DDDK↓IVGG (SEQ ID NO: 244) |
| Protease 3C (PreScission ™) | 239 | LEVLFQ↓GP | LEVLFQ↓GP (SEQ ID NO: 245) |
| Sortase A | 240 | LPKT↓GSES | L/P/KEAD/T↓G/—/EKS/S (SEQ ID NO: 246) |

↓indicates cleavage site
NA: not applicable
*the listing of multiple amino acids before, between, or after a slash indicate alternative amino acids that can be substituted at the position; "—" indicates that any amino acid may be substituted for the corresponding amino acid indicated in the middle column In one embodiment, a BP incorporated into a BPXTEN fusion protein can have a sequence that exhibits at least about 80% sequence identity to a sequence from Tables 3-8, alternatively at least about 81%, or about 82%, or about 83%, or about 84%, or about 85%, or about 86%, or about 87%, or about 88%, or about 89%, or about 90%, or about 91%, or about 92%, or about 93%, or about 94%, or about 95%, or about 96%, or about 97%, or about 98%, or about 99%, or about 100% sequence identity as compared with a sequence from Tables 3-8. The BP of the foregoing embodiment can be evaluated for activity using assays or measured or determined parameters as described herein, and those sequences that retain at least about 40%, or about 50%, or about 55%, or about 60%, or about 70%, or about 80%, or about 90%, or about 95% or more activity compared to the corresponding native BP sequence would be considered suitable for inclusion in the subject BPXTEN. The BP found to retain a suitable level of activity can be linked to one or more XTEN polypeptides described hereinabove. In one embodiment, a BP found to retain a suitable level of activity can be linked to one or more XTEN polypeptides having at least about 80% sequence identity to a sequence from Table 2, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a sequence of Table 2, resulting in a chimeric fusion protein.

Non-limiting examples of sequences of fusion proteins containing a single BP linked to a single XTEN are presented in Table 40, 42, 43, and 44. In one embodiment, a BPXTEN composition would comprise a fusion protein having at least about 80% sequence identity to a BPXTEN from Tables 40, 42, 43, or 44, alternatively at least about 81%, 82%, 83%, 84%, 85%, 86%, 87%, 88%, 89%, 90%, 91%, 92%, 93%, 94%, 95%, 96%, 97%, 98%, 99%, or about 100% sequence identity as compared with a BPXTEN from Tables 40, 42, 43, or 44. Non-limiting examples of sequences of fusion proteins containing two molecules of the same BP linked to one or more XTEN are presented in Table 41, but the invention also contemplates substitution of other BP selected from Tables 3-8 linked to one or two XTEN, which may be the same or different, selected from Table 2. In the foregoing fusion proteins hereinabove described in this paragraph, the BPXTEN fusion protein can further comprise a cleavage sequence from Table 10; the cleavage sequence being located between the BP and the XTEN or between adjacent BP. In some cases, the BPXTEN comprising the cleavage sequences will also have one or more spacer sequence amino acids between the BP and the cleavage sequence or the XTEN and the cleavage sequence to facilitate access of the protease; the spacer amino acids comprising any natural amino acid, including glycine and alanine as preferred amino acids. Non-limiting examples of BPXTEN comprising BP, XTEN, cleavage sequence(s) and spacer amino acids are presented in Tables 42 and 43. However, the invention also contemplates substitution of any of the BP sequences of Tables 3-8 for a BP sequence of Tables 42 or 43, substitution of any XTEN sequence of Table 2 for an XTEN sequence of Tables 42 or 43, and substitution of any cleavage sequence of Table 10 for a cleavage sequence of Tables 42 or 43.

(b) Pharmacokinetic Properties of BPXTEN

The invention provides BPXTEN fusion proteins with enhanced pharmacokinetics compared to the BP not linked to XTEN that, when used at the dose determined for the composition by the methods described herein, can achieve a circulating concentration resulting in a pharmacologic effect, yet stay within the safety range for biologically active component of the composition for an extended period of time compared to a comparable dose of the BP not linked to XTEN. In such cases, the BPXTEN remains within the therapeutic window for the fusion protein composition for the extended period of time. As used herein, a "comparable dose" means a dose with an equivalent moles/kg for the active BP pharmacophore that is administered to a subject in a comparable fashion. It will be understood in the art that a "comparable dosage" of BPXTEN fusion protein would represent a greater weight of agent but would have essentially the same mole-equivalents of BP in the dose of the fusion protein and/or would have the same approximate molar concentration relative to the BP.

The pharmacokinetic properties of a BP that can be enhanced by linking a given XTEN to the BP include terminal half-life, area under the curve (AUC), $C_{max}$ volume of distribution, and bioavailability.

As described more fully in the Examples pertaining to pharmacokinetic characteristics of fusion proteins comprising XTEN, it was surprisingly discovered that increasing the length of the XTEN sequence could confer a disproportionate increase in the terminal half-life of a fusion protein comprising the XTEN. Accordingly, the invention provides BPXTEN fusion proteins comprising XTEN wherein the XTEN can be selected to provide a targeted half-life for the BPXTEN composition administered to a subject. In some embodiments, the invention provides monomeric fusion proteins comprising XTEN wherein the XTEN is selected to confer an increase in the terminal half-life for the administered BPXTEN, compared to the corresponding BP not linked to the fusion protein, of at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold or greater an increase in terminal half-life compared to the BP not linked to the fusion protein. Similarly, the BPXTEN fusion proteins can have an increase in AUC of at least about 50%, or at least about 60%, or at least about 70%, or at least about 80%, or at least about 90%, or at least about 100%, or at least about 150%, or at least about 200%, or at least about 300% increase in AUC compared to the corresponding BP not linked to the fusion protein. The pharmacokinetic parameters of a BPXTEN can be determined by standard methods involving dosing, the taking of blood samples at times intervals, and the assaying of the protein using ELISA, HPLC, radioassay, or other methods known in the art or as described herein, followed by standard calculations of the data to derive the half-life and other PK parameters.

Figure 38:
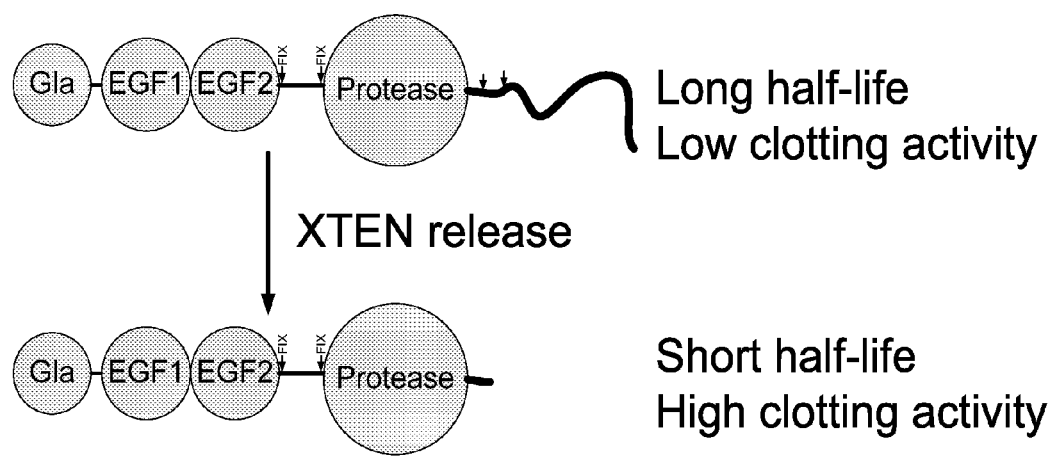
FIG. 38 is a schematic illustration of the release of XTEN from FIX-XTEN. FIX-XTEN with the associated XTEN has increased half-life but is largely in an inactive, pro-drug form. After proteolytic cleavage at the XTEN release sites (arrows), the FIX portion can be activated by the coagulation cascade, but has a short half-life.

The invention further provides BPXTEN comprising a first and a second BP molecule, optionally separated by a spacer sequence that may further comprise a cleavage sequence, or separated by a second XTEN sequence. In one embodiment, the BP has less activity when linked to the fusion protein compared to a corresponding BP not linked to the fusion protein. In such case, as illustrated in FIG. 38, the BPXTEN can be designed such that upon administration to a subject, the BP component is gradually released by cleavage of the cleavage sequence(s), whereupon it regains activity or the ability to bind to its target receptor or ligand. Accordingly, the BPXTEN of the foregoing serves as a prodrug or a circulating depot, resulting in a longer terminal half-life compared to BP not linked to the fusion protein.

(c) Pharmacology and Pharmaceutical Properties of BPXTEN

The present invention provides BPXTEN compositions comprising BP covalently linked to XTEN that can have enhanced properties compared to BP not linked to XTEN, as well as methods to enhance the therapeutic and/or biologic activity or effect of the respective two BP components of the compositions. In addition, the invention provides BPXTEN compositions with enhanced properties compared to those art-known fusion proteins containing immunoglobulin polypeptide partners, polypeptides of shorter length and/or polypeptide partners with repetitive sequences. In addition, BPXTEN fusion proteins provide significant advantages over chemical conjugates, such as pegylated constructs, notably the fact that recombinant BPXTEN fusion proteins can be made in bacterial cell expression systems, which can reduce time and cost at both the research and development and manufacturing stages of a product, as well as result in a more homogeneous, defined product with less toxicity for both the product and metabolites of the BPXTEN compared to pegylated conjugates.

As therapeutic agents, the BPXTEN may possess a number of advantages over therapeutics not comprising XTEN including, for example, increased solubility, increased thermal stability, reduced immunogenicity, increased apparent molecular weight, reduced renal clearance, reduced proteolysis, reduced metabolism, enhanced therapeutic efficiency, a lower effective therapeutic dose, increased bioavailability, increased time between dosages to maintain blood levels within the therapeutic window for the BP, a "tailored" rate of absorption, enhanced lyophilization stability, enhanced serum/plasma stability, increased terminal half-life, increased solubility in blood stream, decreased binding by neutralizing antibodies, decreased receptor-mediated clearance, reduced side effects, retention of receptor/ligand binding affinity or receptor/ligand activation, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), reduced toxicity in an organism or environment and the like. The net effect of the enhanced properties is that the BPXTEN may result in enhanced therapeutic and/or biologic effect when administered to a subject with a metabolic disease or disorder.

In other cases where, where enhancement of the pharmaceutical or physicochemical properties of the BP is desirable, (such as the degree of aqueous solubility or stability), the length and/or the motif family composition of the first and the second XTEN sequences of the first and the second fusion protein may each be selected to confer a different degree of solubility and/or stability on the respective fusion proteins such that the overall pharmaceutical properties of the BPXTEN composition are enhanced. The BPXTEN fusion proteins can be constructed and assayed, using methods described herein, to confirm the physicochemical properties and the XTEN adjusted, as needed, to result in the desired properties. In one embodiment, the XTEN sequence of the BPXTEN is selected such that the fusion protein has an aqueous solubility that is within at least about 25% greater compared to a BP not linked to the fusion protein, or at least about 30%, or at least about 40%, or at least about 50%, or at least about 75%, or at least about 100%, or at least about 200%, or at least about 300%, or at least about 400%, or at least about 500%, or at least about 1000% greater than the corresponding BP not linked to the fusion protein. In the embodiments hereinabove described in this paragraph, the XTEN of the fusion proteins can have at least about 80% sequence identity, or about 90%, or about 91%, or about 92%, or about 93%, or about 94%, or about 95%, or about 96%, or about 97%, or about 98%, or about 99%, to about 100% sequence identity to an XTEN selected from Table 2.

In one embodiment, the invention provides BPXTEN compositions that can maintain the BP component within a therapeutic window for a greater period of time compared to comparable dosages of the corresponding BP not linked to XTEN. It will be understood in the art that a "comparable dosage" of BPXTEN fusion protein would represent a greater weight of agent but would have the same approximate mole-equivalents of BP in the dose of the fusion protein and/or would have the same approximate molar concentration relative to the BP.

The invention also provides methods to select the XTEN appropriate for conjugation to provide the desired pharmacokinetic properties that, when matched with the selection of dose, enable increased efficacy of the administered composition by maintaining the circulating concentrations of the BP within the therapeutic window for an enhanced period of time. As used herein, "therapeutic window" means that amount of drug or biologic as a blood or plasma concentration range, that provides efficacy or a desired pharmacologic effect over time for the disease or condition without unacceptable toxicity; the range of the circulating blood concentrations between the minimal amount to achieve any positive therapeutic effect and the maximum amount which results in a response that is the response immediately before toxicity to the subject (at a higher dose or concentration). Additionally, therapeutic window generally encompasses an aspect of time; the maximum and minimum concentration that results in a desired pharmacologic effect over time that does not result in unacceptable toxicity or adverse events. A dosed composition that stays within the therapeutic window for the subject could also be said to be within the "safety range."

Dose optimization is important for all drugs, especially for those with a narrow therapeutic window. For example, many peptides involved in glucose homeostasis have a narrow therapeutic window. For a BP with a narrow therapeutic window, such as glucagon or a glucagon analog, a standardized single dose for all patients presenting with a variety of symptoms may not always be effective. Since different glucose regulating peptides are often used together in the treatment of diabetic subjects, the potency of each and the interactive effects achieved by combining and dosing them together must also be taken into account. A consideration of these factors is well within the purview of the ordinarily skilled clinician for the purpose of determining the therapeutically or pharmacologically effective amount of the BPXTEN, versus that amount that would result in unacceptable toxicity and place it outside of the safety range.

In many cases, the therapeutic window for the BP components of the subject compositions have been established and are available in published literature or are stated on the drug label for approved products containing the BP. In other cases, the therapeutic window can be established. The methods for establishing the therapeutic window for a given composition are known to those of skill in the art (see, e.g., Goodman & Gilman's The Pharmacological Basis of Therapeutics, 11$^{th}$ Edition, McGraw-Hill (2005)). For example, by using dose-escalation studies in subjects with the target disease or disorder to determine efficacy or a desirable pharmacologic effect, appearance of adverse events, and determination of circulating blood levels, the therapeutic window for a given subject or population of subjects can be determined for a given drug or biologic, or combinations of biologics or drugs. The dose escalation studies can evaluate the activity of a BPXTEN through metabolic studies in a subject or group of subjects that monitor physiological or biochemical parameters, as known in the art or as described herein for one or more parameters associated with the metabolic disease or disorder, or clinical parameters associated with a beneficial outcome for the particular indication, together with observations and/or measured parameters to determine the no effect dose, adverse events, maximum tolerated dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs and above which toxicity occurs, thereby establishing the therapeutic window for the dosed therapeutic. Blood concentrations of the fusion protein (or as measured by the BP component) above the maximum would be considered outside the therapeutic window or safety range. Thus, by the foregoing methods, a $C_{min}$ blood level would be established, below which the BPXTEN fusion protein would not have the desired pharmacologic effect, and a $C_{max}$ blood level would be established that would represent the highest circulating concentration before reaching a concentration that would elicit unacceptable side effects, toxicity or adverse events, placing it outside the safety range for the BPXTEN. With such concentrations established, the frequency of dosing and the dosage can be further refined by measurement of the $C_{max}$ and $C_{min}$ to provide the appropriate dose and dose frequency to keep the fusion protein(s) within the therapeutic window. One of skill in the art can, by the means disclosed herein or by other methods known in the art, confirm that the administered BPXTEN remains in the therapeutic window for the desired interval or requires adjustment in dose or length or sequence of XTEN. Further, the determination of the appropriate dose and dose frequency to keep the BPXTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain within the therapeutic window and results in an improvement in at least one measured parameter relevant for the target disease, disorder or condition. In some cases, the BPXTEN administered at an appropriate dose to a subject may result in blood concentrations of the BPXTEN fusion protein that remains within the therapeutic window for a period at least about two-fold longer compared to the corresponding BP not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer or greater compared to the corresponding BP not linked to XTEN and administered at a comparable dose. As used herein, an "appropriate dose" means a dose of a drug or biologic that, when administered to a subject, would result in a desirable therapeutic or pharmacologic effect and a blood concentration within the therapeutic window.

In one embodiment, the BPXTEN administered at a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the fusion protein and administered at a comparable dose regimen to a subject. In another embodiment, the BPXTEN administered at a therapeutically effective dose regimen results in a comparable improvement in one, or two, or three or more measured parameter using less frequent dosing or a lower total dosage in moles of the fusion protein of the pharmaceutical composition compared to the corresponding biologically active protein component(s) not linked to the fusion protein and administered to a subject using a therapeutically effective dose regimen for the BP. The measured parameters may include any of the clinical, biochemical, or physiological parameters disclosed herein, or others known in the art for assessing subjects with glucose- or insulin-related disorders, metabolic diseases or disorders, coagulation or bleeding disorders, or growth hormone-related disorders.

The activity of the BPXTEN compositions of the invention, including functional characteristics or biologic and pharmacologic activity and parameters that result, may be determined by any suitable screening assay known in the art for measuring the desired characteristic. The activity and structure of the BPXTEN polypeptides comprising BP components may be measured by assays described herein; e.g., one or more assays selected from Table 39, assays of the Examples, or by methods known in the art to ascertain the degree of solubility, structure and retention of biologic activity. Assays can be conducted that allow determination of binding characteristics of the BPXTEN for BP receptors or a ligand, including binding constant ($K_d$), $EC_{50}$ values, as well as their half-life of dissociation of the ligand-receptor complex ($T_{1/2}$). Binding affinity can be measured, for example, by a competition-type binding assay that detects changes in the ability to specifically bind to a receptor or ligand. Additionally, techniques such as flow cytometry or surface plasmon resonance can be used to detect binding events. The assays may comprise soluble receptor molecules, or may determine the binding to cell-expressed receptors. Such assays may include cell-based assays, including assays for proliferation, cell death, apoptosis and cell migration. Other possible assays may determine receptor binding of expressed polypeptides, wherein the assay may comprise soluble receptor molecules, or may determine the binding to cell-expressed receptors. The binding affinity of a BPXTEN for the target receptors or ligands of the corresponding BP can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. In addition, BP sequence variants (assayed as single components or as BPXTEN fusion proteins) can be compared to the native BP using a competitive ELISA binding assay to determine whether they have the same binding specificity and affinity as the native BP, or some fraction thereof such that they are suitable for inclusion in BPXTEN.

The invention provides isolated BPXTEN in which the binding affinity for BP target receptors or ligands by the BPXTEN can be at least about 10%, or at least about 20%, or at least about 30%, or at least about 40%, or at least about 50%, or at least about 60%, or at least about 70%, or at least about 80%, or at least about 90%, or at least about 95%, or at least about 99%, or at least about 100% or more of the affinity of a native BP not bound to XTEN for the target receptor or ligand. In some cases, the binding affinity $K_d$ between the subject BPXTEN and a native receptor or ligand of the BPXTEN is at least about $10^{-4}$M, alternatively at least about $10^{-5}$M, alternatively at least about $10^{-6}$M, or at least about $10^{-7}$M of the affinity between the BPXTEN and a native receptor or ligand.

In other cases, the invention provides isolated BPXTEN in which the fusion protein is designed to bind with high affinity to a target receptor, thereby resulting in antagonistic activity for the native ligand. A non-limiting example of such a BPXTEN is IL-1raXTEN, which is configured to bind to an IL-1 receptor such that the bound composition substantially interferes with the binding of IL-1α and/or IL-1β to IL-1 receptor. In certain cases, the interference by an antagonist BPXTEN (such as, but not limited to IL-1raXTEN) with the binding the native ligand to the target receptor can be at least about 1%, or about 10%, or about 20%, or about 30%, or about 40%, or about 50%, or about 60%, or about 70%, or about 80%, or about 90%, or about 95%, or about 99%, or about 100%. In other embodiments, the invention provides isolated BPXTEN fusion proteins (such as, but not limited to IL-1raXTEN) wherein the binding of the isolated fusion protein to a cellular receptor elicits less than 20%, or less than 10%, or less than 5% activation of the signaling pathways of the cell with bound BPXTEN antagonist in comparison to those evoked by the native ligand. In other cases, the antagonistic BPXTEN compositions bind to the target receptor with a dissociation constant of about 10 nM or less, about 5 nM or less, about 1 nM or less, about 500 μM or less, about 250 μM or less, about 100 μM or less, about 50 μM or less, or about 25 μM or less. Non-limiting examples of specific constructs of antagonistic BPXTEN can include IL-1ra-AM875, IL-1ra-AE864, or IL-1ra-AM1296.

Figure 3:
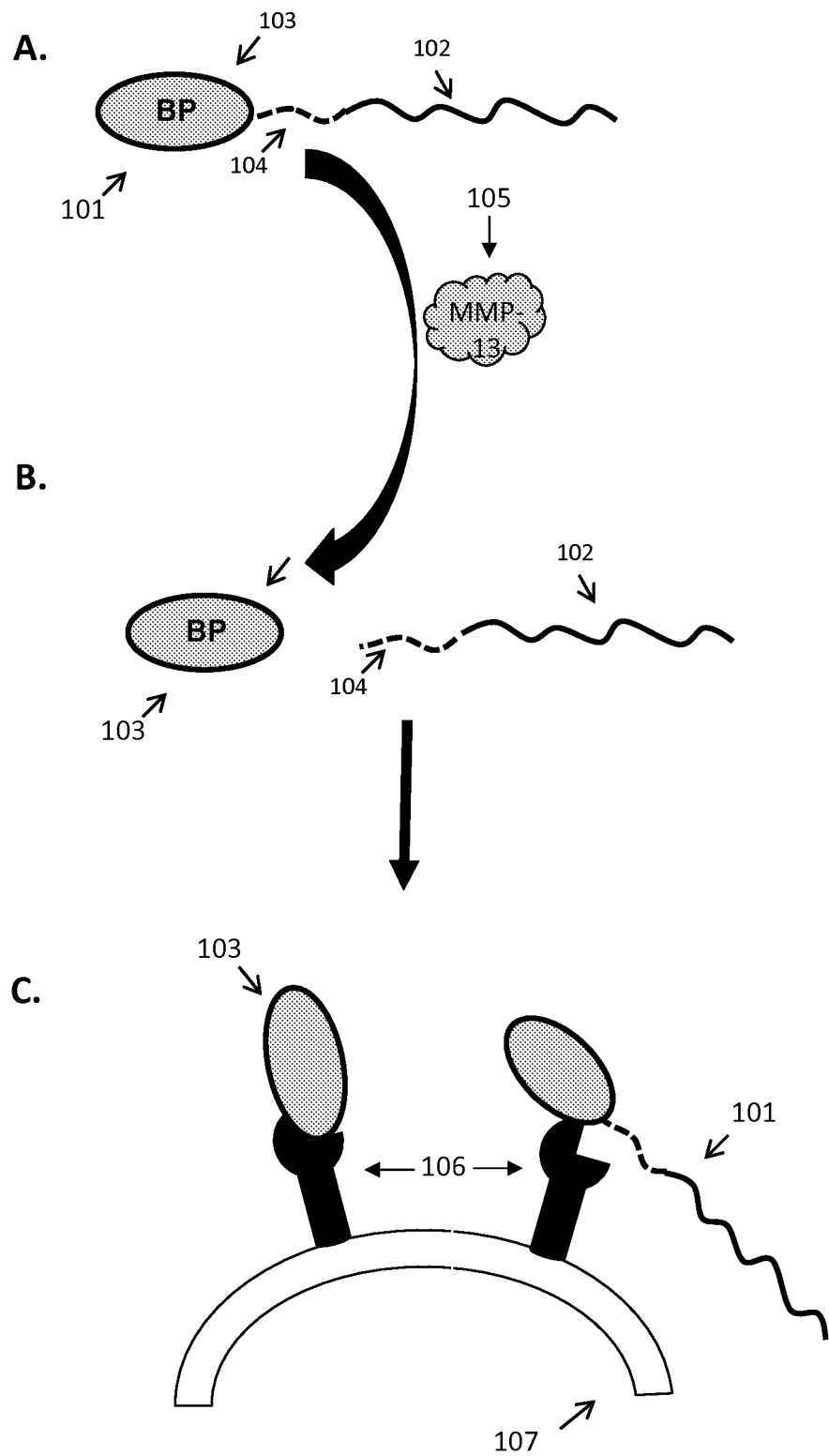
FIG. 3 is a schematic illustration of an exemplary monomeric BPXTEN acted upon by an endogenously available protease and the ability of the monomeric fusion protein or the reaction products to bind to a target receptor on a cell surface, with subsequent cell signaling.
Figure 3:
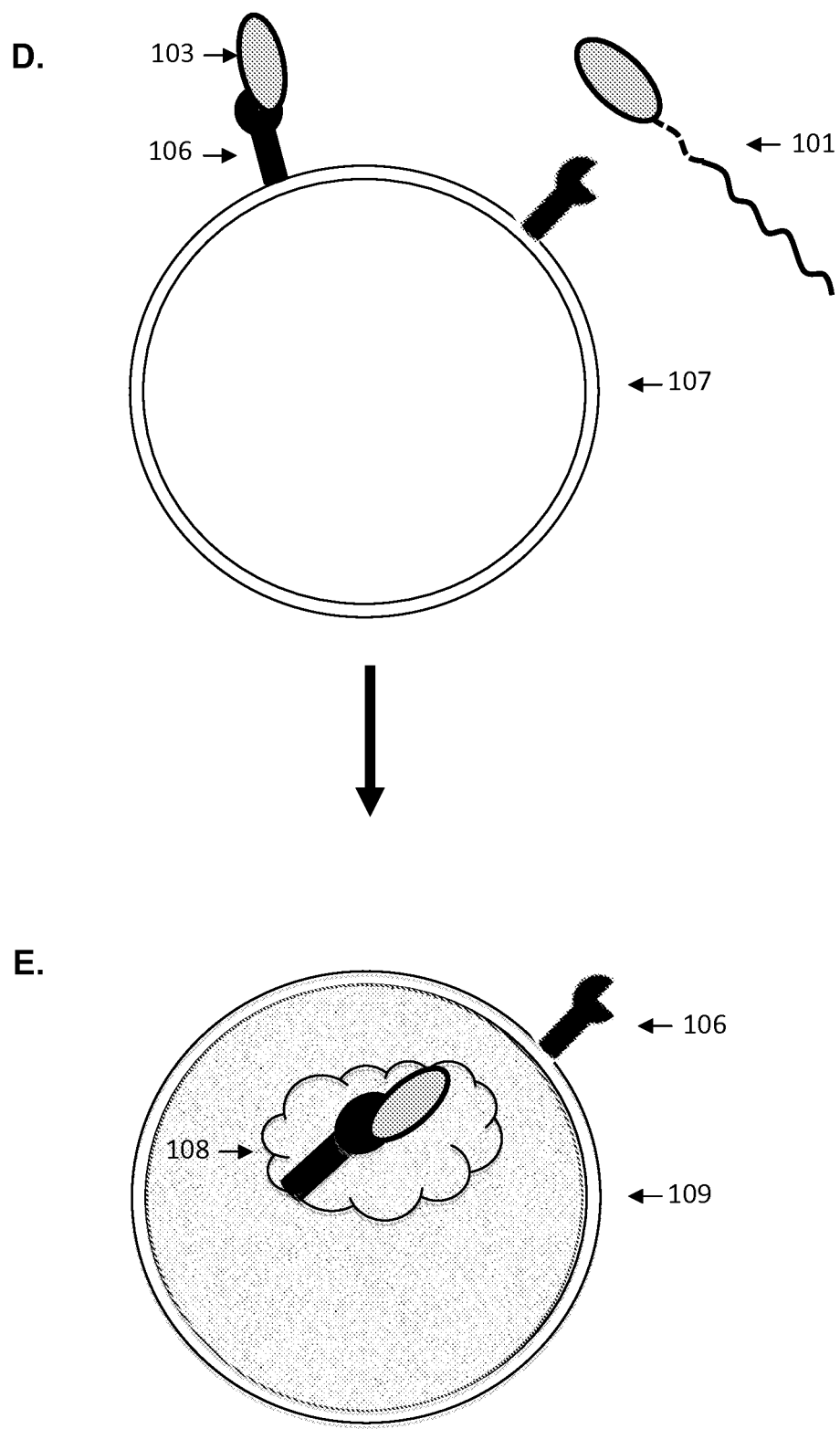

In some cases, the BPXTEN fusion proteins of the invention retain at least about 10%, or about 20%, 30%, 40%, 50%, 60%, 70%, 80%, 90%, 95%, 98%, or 99% percent of the biological activity of the corresponding BP not linked to the fusion protein with regard to an in vitro biologic activity or pharmacologic effect known or associated with the use of the native BP in the treatment and prevention of metabolic conditions and disorders. In some cases of the foregoing embodiment, the activity of the BP component may be manifest by the intact BPXTEN fusion protein, while in other cases the activity of the BP component would be primarily manifested upon cleavage and release of the BP from the fusion protein by action of a protease that acts on a cleavage sequence incorporated into the BPXTEN fusion protein. In the foregoing, as illustrated in FIG. 3, the BPXTEN can be designed to reduce the binding affinity of the BP component for the receptor or ligand when linked to the XTEN but have increased affinity when released from XTEN through the cleavage of cleavage sequence(s) incorporated into the BPXTEN sequence, as described more fully above.

In other cases, the BPXTEN are designed to reduce the binding affinity of the BP component when linked to the XTEN to, for example, increase the terminal half-life of BPXTEN administered to a subject by reducing receptor-mediated clearance or to reduce toxicity or side effects due to the administered composition. Where the toxicological no-effect dose or blood concentration of a BP not linked to an XTEN is low (meaning that the native peptide has a high potential to result in side effects), the invention provides BPXTEN fusion proteins in which the fusion protein is configured to reduce the biologic potency or activity of the BP component.

In some cases, it has been found that a BPXTEN can be configured to have a substantially reduced binding affinity (expressed as Kd) and a corresponding reduced bioactivity, compared to the activity of a BPXTEN wherein the configuration does not result in reduced binding affinity of the corresponding BP component, and that such configuration is advantageous in terms of having a composition that displays both a long terminal half-life and retains a sufficient degree of bioactivity. In one example, it has been found that while linking a single XTEN to the C-terminus of glucagon results in the retention of significant binding affinity to its target receptor (see Example 31), linking an XTEN to the N-terminus decreases its binding affinity and corresponding biological activity, compared to constructs where the XTEN is bound to the C-terminus. In another example, it has been found, as described in the Examples, that while linking of human growth hormone (hGH) to the C-terminus of an XTEN molecule does not substantially interfere with the binding to hGH receptors, the addition of a second XTEN to the C-terminus of the same molecule (placing the second XTEN to the C-terminus of hGH) reduced the affinity of the molecule to the hGH receptor and also resulted in an increase in terminal half-life of the XTEN-hGH-XTEN configuration compared to XTEN-hGH configuration. The ability to reduce binding affinity of the BP to its target receptor may be dependent on the requirement to have a free N- or C-terminus for the particular BP. Accordingly, the invention provides a method for increasing the terminal half-life of a BPXTEN by producing a single-chain fusion protein construct with a specific N- to C-terminus configuration of the components comprising at least a first biologically active protein and one or more XTEN, wherein the fusion protein in a first N- to C-terminus configuration of the biologically active protein and XTEN components has reduced receptor-mediated clearance (RMC) and a corresponding increase in terminal half-life compared to a BPXTEN in a second N- to C-terminus configuration. In one embodiment of the foregoing, the BPXTEN is configured, N- to C-terminus as BP-XTEN. In another embodiment of the foregoing, the BPXTEN is configured XTEN-BP. In another embodiment of the foregoing, the BPXTEN is configured XTEN-BP-XTEN. In the latter embodiment, the two XTEN molecules can be identical or they can be of a different sequence composition or length. Non-limiting examples of the foregoing embodiment with two XTEN linked to a single BP include the constructs AE921-hGH-AE144 (SEQ ID NO: 1817), AE921-hGH-AE288 (SEQ ID NO: 1818, AE864-hGH-AE144, AM875-hGH-AE144, and AM875-hGH-AE288. Non-limiting examples of the foregoing embodiment with one BP linked to one XTEN include AE144-glucagon (SEQ ID NO: 827), AE288-glucagon (SEQ ID NO: 828), AD576-glucagon (SEQ ID NO: 831), AM923-glucagon (SEQ ID NO: 840), Y72-glucagon (SEQ ID NO: 823), AM875-IL-1ra or AE864-IL-1ra. The invention contemplates other such constructs in which a BP from Tables 3-8 and XTEN from Table 2 are substituted for the respective components of the foregoing examples, and configured such that the construct has reduced receptor mediated clearance compared to an alternate configuration of the respective components.

In some cases, the method provides configured BPXTEN in which the reduced receptor mediated clearance can result in an increase in the terminal half-life of at least two-fold, or at least three-fold, or at least four-fold, or at least five-fold compared to the half-life of a BPXTEN in a second configuration where RMC is not reduced. The invention takes advantage of BP ligands wherein reduced binding affinity to a receptor, either as a result of a decreased on-rate or an increased off-rate, may be effected by the obstruction of either the N- or C-terminus, and using that terminus as the linkage to another polypeptide of the composition, whether another BP, an XTEN, or a spacer sequence. The choice of the particular configuration of the BPXTEN fusion protein can reduce the degree of binding affinity to the receptor such that a reduced rate of receptor-mediated clearance can be achieved. Generally, activation of the receptor is coupled to RMC such that binding of a polypeptide to its receptor without activation does not lead to RMC, while activation of the receptor leads to RMC. However, in some cases, particularly where the ligand has an increased off rate, the ligand may nevertheless be able to bind sufficiently to initiate cell signaling without triggering receptor mediated clearance, with the net result that the BPXTEN remains bioavailable. In such cases, the configured BPXTEN has an increased half-life compared to those configurations that lead to a higher degree of RMC.

In cases where a reduction in binding affinity is desired in order to reduce receptor-mediated clearance but retention of at least a portion of the biological activity is desired, it will be clear that sufficient binding affinity to obtain the desired receptor activation must nevertheless be maintained. Thus, in one embodiment, the invention provides a BPXTEN configured such that the binding affinity of the BPXTEN for a target receptor is in the range of about 0.01%-40%, or about 0.1%-30%, or about 1%-20% of the binding affinity compared to a corresponding BPXTEN in a configuration wherein the binding affinity is not reduced. The binding affinity of the configured BXTEN is thus preferably reduced by at least about 80%, or at least about 85%, or at least about 90%, or at least about 95%, or at least about 99%, or at least about 99.9%, or at least about 99.99% as compared to the binding affinity of a corresponding BPXTEN in a configuration wherein the binding affinity of the BP component to the target receptor is not reduced or compared to the BP not linked to the fusion protein, determined under comparable conditions. Expressed differently, the BP component of the configured BPXTEN may have a binding affinity that is as small as about 0.01%, or at least about 0.1%, or at least about 1%, or at least about 2%, or at least about 3%, or at least about 4%, or at least about 5%, or at least about 10%, or at least about 20% of that of the corresponding BP component of a BPXTEN in a configuration wherein the binding affinity of the BP component is not reduced. In the foregoing embodiments hereinabove described in this paragraph, the binding affinity of the configured BPXTEN for the target receptor would be "substantially reduced" compared to a corresponding native BP or a BPXTEN with a configuration in which the binding affinity of the corresponding BP component is not reduced. Accordingly, the present invention provides compositions and methods to produce compositions with reduced RMC by configuring the BPXTEN so as to be able to bind and activate a sufficient number of receptors to obtain a desired in vivo biological response yet avoid activation of more receptors than is required for obtaining such response. In one embodiment, the BPXTEN is configured such that the subject BP is at the N-terminus of the BPXTEN, wherein the RMC of the administered BPXTEN is reduced compared to a BPXTEN configured with the subject BP linked to the C-terminus of an XTEN and at least a portion of the biological activity of the native BP is retained. In another embodiment, the BPXTEN is configured such that the subject BP is at the C-terminus of the BPXTEN, wherein the RMC of the administered BPXTEN is reduced compared to a BPXTEN configured with the subject BP is at the N-terminus of the BPXTEN and at least a portion of the biological activity of the native BP is retained. In another embodiment, the BPXTEN is configured, N- to C-terminus, as XTEN-BP-XTEN, wherein the RMC of the administered BPXTEN is reduced compared to a BPXTEN configured with one XTEN and at least a portion of the biological activity of the native BP is retained. It will be apparent to one of skill in the art that other configurations to achieve this property are contemplated by the invention; e.g., addition of a second molecule of the BP or a spacer sequence. In the foregoing embodiments hereinabove described in this paragraph, the half-life of the BPXTEN can be increased at least about 50%, or at least about 75%, or at least about 100%, or at least about 150%, or at least about 200%, or at least about 300% compared to a BPXTEN configured wherein the binding affinity and RMC of the BP component is not reduced. In the foregoing embodiments hereinabove described in this paragraph, the increased half-life can permit higher dosages and reduced frequency of dosing compared to BP not linked to XTEN or compared to BPXTEN configurations wherein the BP component retains a binding affinity to the receptor comparable to the native BP.

Specific in vivo and ex vivo biological assays may also be used to assess the biological activity of each configured BPXTEN and/or BP component to be incorporated into BPXTEN. For example, the increase of insulin secretion and/or transcription from the pancreatic beta cells can be measured by methods known in the art. Glucose uptake by tissues can also be assessed by methods such as the glucose clamp assay and the like. Other in vivo and ex vivo parameters suitable to assess the activity of administered BPXTEN fusion proteins in treatment of metabolic diseases and disorders include fasting glucose level, peak postprandial glucose level, glucose homeostasis, response to oral glucose tolerance test, response to insulin challenge, $HA_{1c}$, caloric intake, satiety, rate of gastric emptying, pancreatic secretion, insulin secretion, peripheral tissue insulin sensitivity, beta cell mass, beta cell destruction, blood lipid levels or profiles, body mass index, or body weight. Based on the results of these assays or other assays known in the art, the BPXTEN configuration or composition can be confirmed or, if needed, adjusted and re-assayed to confirm the target binding affinity or biologic activity.

Specific assays and methods for measuring the physical and structural properties of expressed proteins are known in the art, including methods for determining properties such as protein aggregation, solubility, secondary and tertiary structure, melting properties, contamination and water content, etc. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

V). Uses of the Compositions of the Present Invention

In another aspect, the invention provides a method of for achieving a beneficial effect in a disease, disorder or condition mediated by BP. The present invention addresses disadvantages and/or limitations of BP that have a relatively short terminal half-life and/or a narrow therapeutic window between the minimum effective dose and the maximum tolerated dose.

In one embodiment, the invention provides a method for achieving a beneficial affect in a subject comprising the step of administering to the subject a therapeutically- or prophylactically-effective amount of a BPXTEN. The effective amount can produce a beneficial effect in helping to treat a disease or disorder. In some cases, the method for achieving a beneficial effect can include administering a therapeutically effective amount of a BPXTEN fusion protein composition to treat a subject with a glucose-related or metabolic disease, disorder, or condition, including, but not limited to, Type 1 diabetes, Type 2 diabetes, Syndrome X, insulin resistance, hyperinsulinemia, atherosclerosis, diabetic neuropathy, dyslipidemia, obesity, eating disorders, gestational diabetes, hypercholesterolemia, hypertension, insufficient pancreatic beta cell mass, pulmonary hypertension, or retinal neurodegenerative processes. Other examples of glucose-related or metabolic diseases or clinical disorders that may benefit from treatment with the BPXTEN compositions of the present invention include, but are not limited to, the "honeymoon period" of Type I diabetes, juvenile diabetes, excessive appetite, insufficient satiety, metabolic disorder, glucagonomas, Crohn's disease, ulcerative colitis, renal failure, congestive heart failure, nephrotic syndrome, disorders wherein the reduction of food intake is desired, post-surgical catabolic changes, hibernating myocardium or diabetic cardiomyopathy, insufficient urinary sodium excretion, excessive urinary potassium concentration, conditions or disorders associated with toxic hypervolemia, polycystic ovary syndrome, nephropathy, gastrointestinal disorders such as diarrhea, postoperative dumping syndrome, irritable bowel syndrome, critical illness polyneuropathy (CIPN), systemic inflammatory response syndrome (SIRS), dyslipidemia, stroke, reperfusion injury following ischemia, and coronary heart disease risk factor (CHDRF) syndrome, or disorders wherein the reduction of food intake is desired.

In some cases, the method for achieving a beneficial effect can include administering a therapeutically effective amount of a BPXTEN fusion protein composition to treat a subject with a coagulation protein deficiency or a bleeding disorder, including but not limited to Factor VII deficiency, Factor X deficiency, Factor XII deficiency, hemophilia A, hemophilia B (Christmas Disease), hemophilia C, idiopathic thrombocytopenic purpura (ITP), Von Willebrand's disease (type I and type II), trauma-associated bleeding, or surgical bleeding.

In other cases, the method for achieving a beneficial effect can include administering a therapeutically effective amount of a BPXTEN fusion protein composition to treat a subject with a growth-hormone related disorder or condition that can include, but not be limited to, GH deficiency in adults and children, Turner's Syndrome, Prader-Willi Syndrome, chronic renal failure, intrauterine growth retardation, idiopathic short stature, AIDS wasting, obesity, multiple sclerosis, aging, fibromyalgia, Crohn's disease, ulcerative colitis, muscular dystrophy or low muscle mass (e.g. bodybuilding), low bone density, or any other indication for which GH is utilized.

In one embodiment, the method comprises administering a therapeutically-effective amount of a pharmaceutical composition comprising a BPXTEN fusion protein composition comprising a BP linked to an XTEN sequence(s) and at least one pharmaceutically acceptable carrier to a subject in need thereof that results in greater improvement in at least one parameter, physiologic condition, or clinical outcome mediated by the BP component(s) compared to the effect mediated by administration of a pharmaceutical composition comprising a BP not linked to XTEN and administered at a comparable dose. In one embodiment, the pharmaceutical composition is administered at a therapeutically effective dose. In another embodiment, the pharmaceutical composition is administered using multiple consecutive doses using a therapeutically effective dose regimen (as defined herein) for the length of the dosing period.

As a result of the enhanced PK parameters of BPXTEN, as described herein, the BP may be administered using longer intervals between doses compared to the corresponding BP not linked to XTEN to prevent, treat, alleviate, reverse or ameliorate symptoms or clinical abnormalities of the metabolic disease, disorder or condition or prolong the survival of the subject being treated.

The methods of the invention may include administration of consecutive doses of a therapeutically effective amount of the BPXTEN for a period of time sufficient to achieve and/or maintain the desired parameter or clinical effect, and such consecutive doses of a therapeutically effective amount establishes the therapeutically effective dose regimen for the BPXTEN; i.e., the schedule for consecutively administered doses of the fusion protein composition, wherein the doses are given in therapeutically effective amounts to result in a sustained beneficial effect on any clinical sign or symptom, aspect, measured parameter or characteristic of a metabolic disease state or condition, including, but not limited to, those described herein.

A therapeutically effective amount of the BPXTEN may vary according to factors such as the disease state, age, sex, and weight of the individual, and the ability of the antibody or antibody portion to elicit a desired response in the individual. A therapeutically effective amount is also one in which any toxic or detrimental effects of the BPXTEN are outweighed by the therapeutically beneficial effects. A prophylactically effective amount refers to an amount of BPXTEN required for the period of time necessary to achieve the desired prophylactic result.

For the inventive methods, longer acting BPXTEN compositions are preferred, so as to improve patient convenience, to increase the interval between doses and to reduce the amount of drug required to achieve a sustained effect. In one embodiment, a method of treatment comprises administration of a therapeutically effective dose of a BPXTEN to a subject in need thereof that results in a gain in time spent within a therapeutic window established for the fusion protein of the composition compared to the corresponding BP component(s) not linked to the fusion protein and administered at a comparable dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold compared to the corresponding BP component not linked to the fusion protein and administered at a comparable dose to a subject. The methods further provide that administration of multiple consecutive doses of a BPXTEN administered using a therapeutically effective dose regimen to a subject in need thereof can result in a gain in time between consecutive $C_{max}$ peaks and/or $C_{min}$ troughs for blood levels of the fusion protein compared to the corresponding BP(s) not linked to the fusion protein and administered using a dose regimen established for that BP. In the foregoing embodiment, the gain in time spent between consecutive $C_{max}$ peaks and/or $C_{min}$ troughs can be at least about three-fold, or at least about four-fold, or at least about five-fold, or at least about six-fold, or at least about eight-fold, or at least about 10-fold, or at least about 20-fold, or at least about 40-fold compared to the corresponding BP component(s) not linked to the fusion protein and administered using a dose regimen established for that BP. In the embodiments hereinabove described in this paragraph the administration of the fusion protein can result in an improvement in at least one of the parameters (disclosed herein as being useful for assessing the subject diseases, conditions or disorders) using a lower unit dose in moles of fusion protein compared to the corresponding BP component(s) not linked to the fusion protein and administered at a comparable unit dose or dose regimen to a subject.

In one embodiment, the BPXTEN can have activity that results in an improvement in one of the clinical, biochemical or physiologic parameters that is greater than the activity of the BP component not linked to XTEN, determined using the same assay or based on a measured clinical parameter. In another embodiment, the BPXTEN can have activity in two or more clinical or metabolic-related parameters (e.g., glucose homeostasis and weight control in a diabetic subject, or reduced prothrombin and bleeding times in a hemophiliac subject, or increased muscle mass and bone density in a growth-hormone deficient subject), each mediated by one of the different BP that collectively result in an enhanced effect compared the BP component not linked to XTEN, determined using the same assays or based on measured clinical parameters. In another embodiment, administration of the BPXTEN can result in activity in one or more of the clinical or biochemical or physiologic parameters that is of longer duration than the activity of one of the single BP components not linked to XTEN, determined using that same assay or based on a measured clinical parameter.

In one embodiment, the method of treatment comprises administration of a BPXTEN using a therapeutically effective dose regimen to effect improvements in one or more parameters associated with diabetes or insulin resistance. In the foregoing embodiment, the improvements may be assessed by a primary efficacy or clinical endpoint, for example an improvement in hemoglobin A1c (HbA1c, see for example Reynolds et al., BMJ, 333(7568):586-589, 2006). Improvements in HbA1c that are indicative of therapeutic efficacy may vary depending on the initial baseline measurement in a patient, with a larger decrease often corresponding to a higher initial baseline and a smaller decrease often corresponding to a lower initial baseline. In some embodiments, the method can result in an HbA1c decrease of at least about 0.5%, or alternatively at least about 1%, or alternatively at least about 1.5%, or alternatively at least about 2%, or alternatively at least about 2.5%, or alternatively at least about 3%, or alternatively at least about 3.5%, or at least about 4% or more compared with pre-dose levels. In other embodiments, the method of treatment can result in fasting blood sugar (e.g., glucose) levels to less than 130 mg/dL, alternatively less than 125 mg/dL, alternatively less than 120 mg/dL, alternatively less than 115 mg/dL, alternatively less than 110 mg/dL, alternatively less than 105 mg/dL, or fasting blood sugar levels less than 100 mg/dL. In other embodiments, the method can result in reductions in fasting blood sugar (e.g., glucose) levels of greater than about 20%, more preferably greater than about 30%, more preferably greater than about 40%, more preferably greater than about 50%, more preferably greater than about 60%, more preferably greater than about 70%, more preferably greater than about 80%, and most preferably greater than about 90% compared to pre-dose levels. In other embodiments, the method can result in 120 minute oral glucose tolerance test (OGTT) glucose levels of less than about 200 mg/dL, more preferably less than about 190 mg/dL, more preferably less than about 180 mg/dL, more preferably less than about 170 mg/dL, more preferably less than about 160 mg/dL, more preferably less than about 150 mg/dL, and most preferably less than about 140 mg/dL. Other examples of methods of treatment being assessed by a parameter included improving prothromin times in a subject with hemophilia; e.g., administering a BPXTEN comprising a FIX can result in a prothrombin time that is at least about 40%, more preferably at least about 50%, more preferably at least about 60%, more preferably at least about 70%, more preferably at least about 80%, more preferably at least about 90%, or more preferably at least about 95% compared to a normal subject.

The invention further contemplates that BPXTEN used in accordance with the methods provided herein may be administered in conjunction with other treatment methods and pharmaceutical compositions useful for treating diabetes, insulin resistance, metabolic disorders, bleeding disorders, or growth disorders. Such compositions, may include for example, DPP-IV inhibitors, insulin, insulin analogues, PPAR gamma agonists, dual-acting PPAR agonists, GLP-1 agonists or analogues, PTP1B inhibitors, SGLT inhibitors, insulin secretagogues, RXR agonists, glycogen synthase kinase-3 inhibitors, insulin sensitizers, immune modulators, beta-3 adrenergic receptor agonists, Pan-PPAR agonists, 11beta-HSD1 inhibitors, biguanides, alpha-glucosidase inhibitors, meglitinides, thiazolidinediones, sulfonylureas and other diabetes medicants known in the art, or anti-hypertensive drugs, calcium channel blockers, or coagulation factors and related products. In some cases, the administration of a BPXTEN may permit use of lower dosages of the co-administered pharmaceutical composition to achieve a comparable clinical effect or measured parameter for the disease, disorder or condition in the subject.

The foregoing notwithstanding, in certain embodiments, the BPXTEN used in accordance with the methods of the present invention may prevent or delay the need for additional treatment methods or use of drugs or other pharmaceutical compositions in subjects with glucose-related diseases, metabolic diseases or disorders, coagulation disorders, or growth-hormone deficiency or growth disorders. In other embodiments, the BPXTEN may reduce the amount, frequency or duration of additional treatment methods or drugs or other pharmaceutical compositions required to treat the underlying disease, disorder or condition.

In another aspect, the invention provides a method of designing the BPXTEN compositions with desired pharmacologic or pharmaceutical properties. The BPXTEN fusion proteins are designed and prepared with various objectives in mind (compared to the BP components not linked to the fusion protein), including improving the therapeutic efficacy for the treatment of metabolic diseases or disorders, enhancing the pharmacokinetic characteristics of the fusion proteins compared to the BP, lowering the dose or frequency of dosing required to achieve a pharmacologic effect, enhancing the pharmaceutical properties, and to enhance the ability of the BP components to remain within the therapeutic window for an extended period of time.

Figure 4:
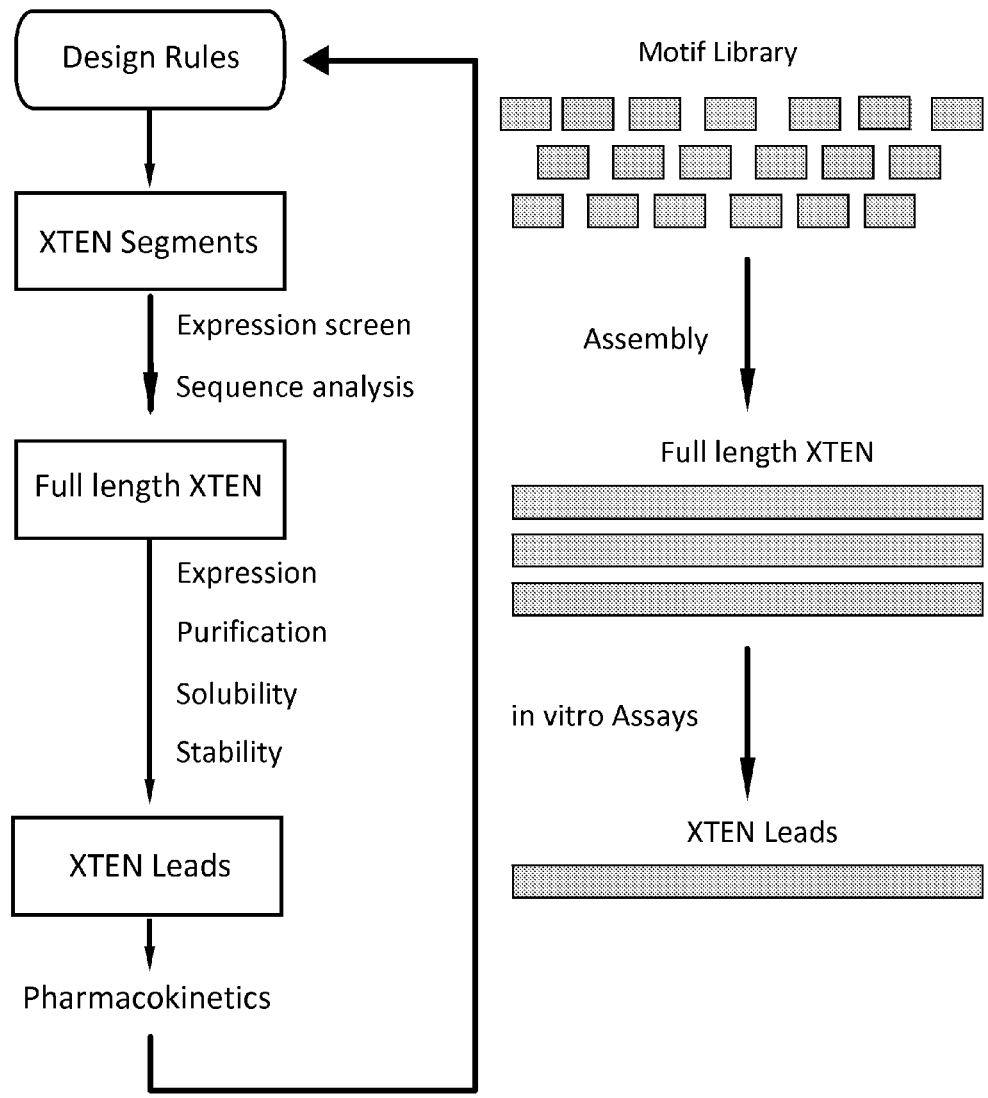
FIG. 4 is a schematic flowchart of representative steps in the assembly, production and the evaluation of a XTEN.
Figure 5:
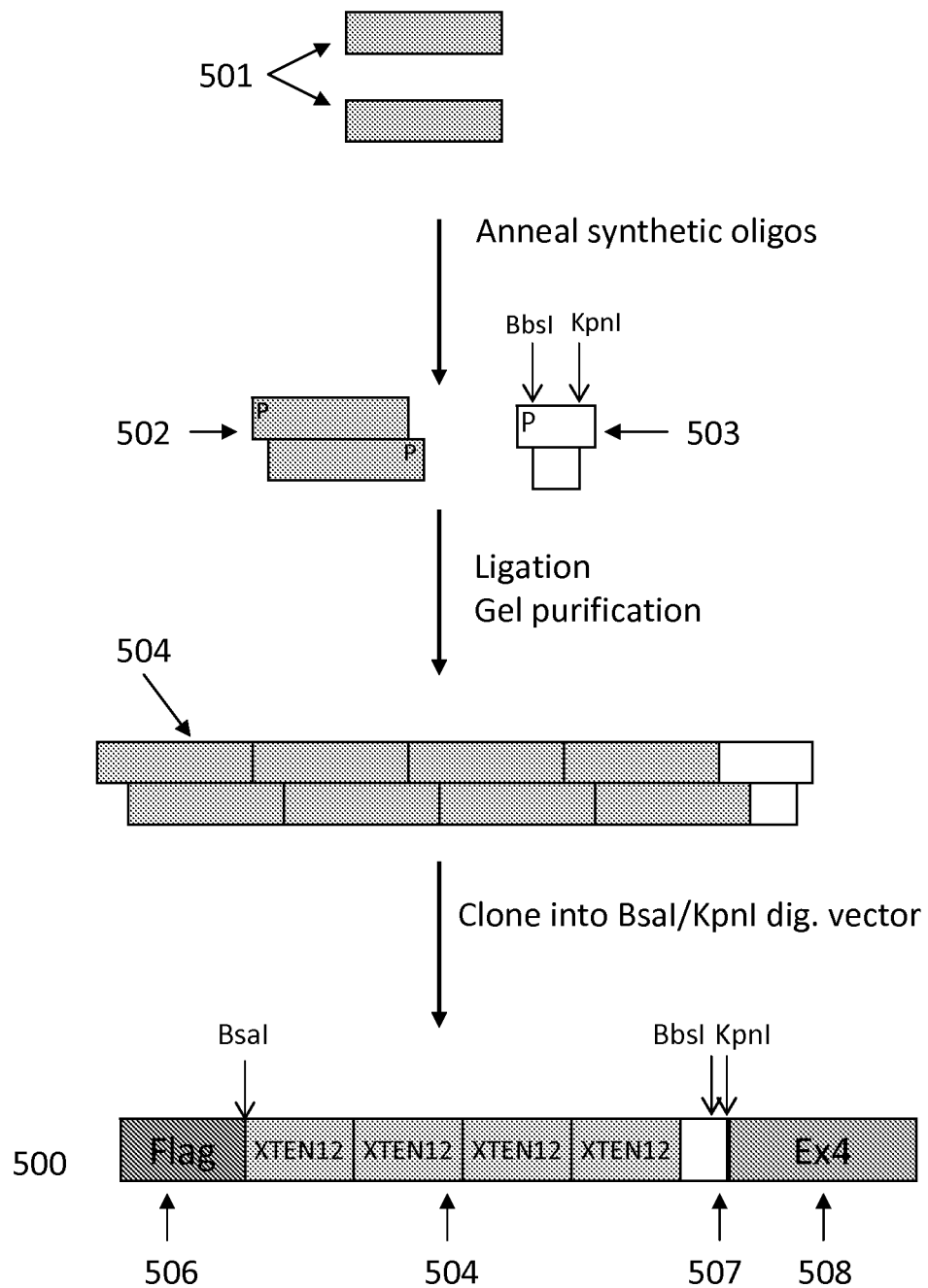
FIG. 5 is a schematic flowchart of representative steps in the assembly of a BP-XTEN polynucleotide construct encoding a fusion protein. Individual oligonucleotides 501 are annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector encodes a Flag sequence 506 followed by a stopper sequence that is flanked by BsaI, BbsI, and KpnI sites 507 and an exendin-4 gene 508, resulting in the gene 500 encoding an BP-XTEN fusion for incorporation into a BPXTEN combination.
Figure 6:
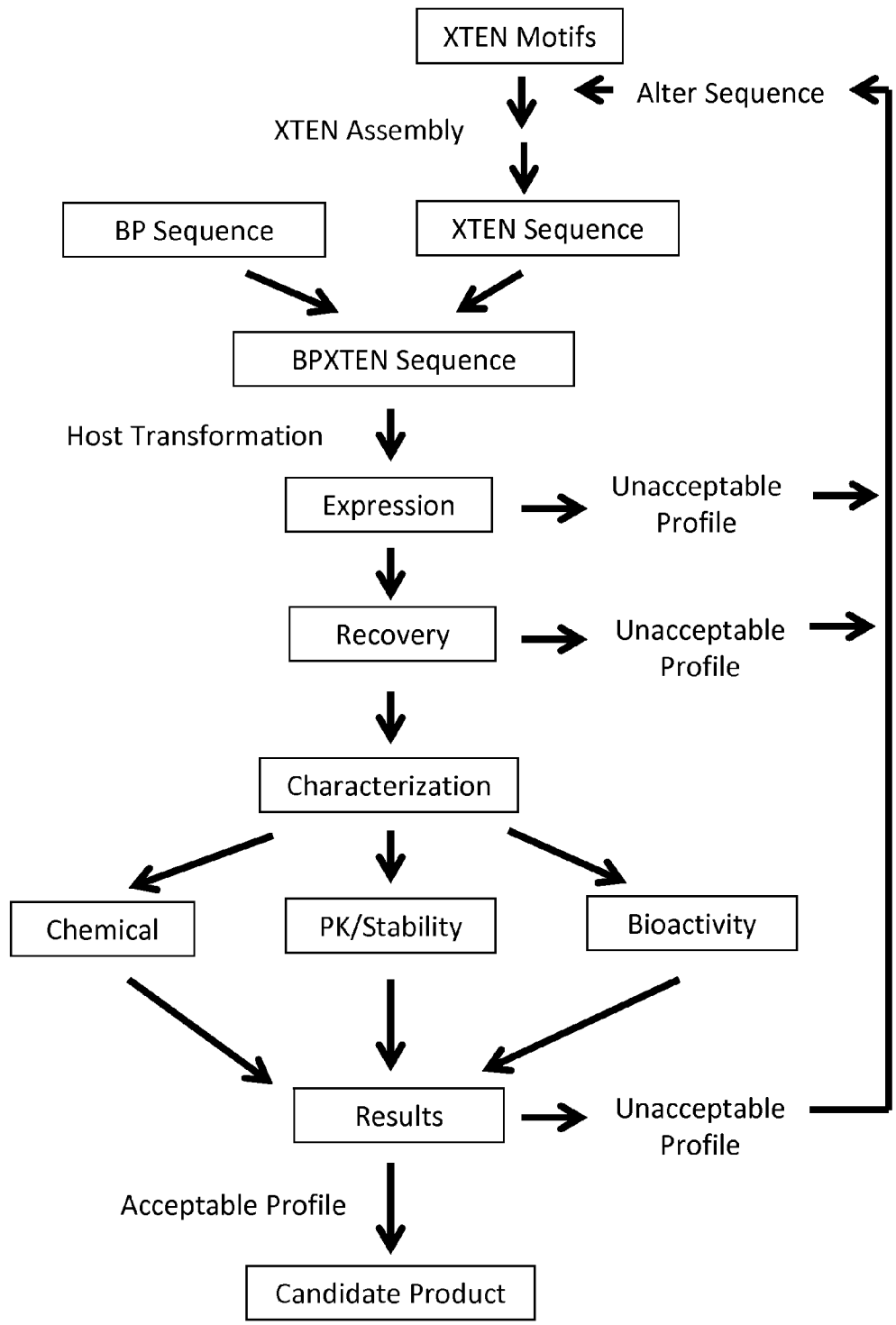
FIG. 6 is a schematic flowchart of representative steps in the assembly of a gene encoding fusion protein comprising a biologically active protein (BP) and XTEN, its expression and recovery as a fusion protein, and its evaluation as a candidate BPXTEN product.

In general, the steps in the design and production of the fusion proteins and the inventive compositions may, as illustrated in FIGS. 4-6, include: (1) the selection of BPs (e.g., native proteins, peptide hormones, peptide analogs or derivatives with activity, peptide fragments, etc.) to treat the particular disease, disorder or condition; (2) selecting the XTEN that will confer the desired PK and physicochemical characteristics on the resulting BPXTEN (e.g., the administration of the composition to a subject results in the fusion protein being maintained within the therapeutic window for a greater period compared to BP not linked to XTEN); (3) establishing a desired N- to C-terminus configuration of the BPXTEN to achieve the desired efficacy or PK parameters; (4) establishing the design of the expression vector encoding the configured BPXTEN; (5) transforming a suitable host with the expression vector; and (6) expression and recovery of the resultant fusion protein. For those BPXTEN for which an increase in half-life (greater than 16 h) or an increased period of time spent within a therapeutic window is desired, the XTEN chosen for incorporation will generally have at least about 500, or about 576, or about 864, or about 875, or about 913, or about 924 amino acid residues where a single XTEN is to be incorporated into the BPXTEN. In another embodiment, the BPXTEN can comprise a first XTEN of the foregoing lengths, and a second XTEN of about 144, or about 288, or about 576, or about 864, or about 875, or about 913, or about 924 amino acid residues.

In other cases, where in increase in half-life is not required, but an increase in a pharmaceutical property (e.g., solubility) is desired, a BPXTEN can be designed to include XTEN of shorter lengths. In some embodiments of the foregoing, the BPXTEN can comprise a BP linked to an XTEN having at least about 24, or about 36, or about 48, or about 60, or about 72, or about 84, or about 96 amino acid residues, in which the solubility of the fusion protein under physiologic conditions is at least three-fold greater than the corresponding BP not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than glucagon not linked to XTEN. In one embodiment of the foregoing, the BP is glucagon. In another embodiment of the foregoing, a BPXTEN can comprise glucagon and a polypeptide sequence selected from Tables 12-15. In still other cases, where a half-life of 2-6 hours for a glucagon-containing BPXTEN fusion protein is desired (e.g., in the treatment of nocturnal hypoglycemia), a fusion protein can be designed with XTEN of intermediate lengths such as about 100 amino acids, or about 144 amino acids, or about 156 amino acids, or about 168 amino acids, or about 180 amino acids, or about 196 amino acids in the XTEN component of the glucagon-containing BPXTEN.

In another aspect, the invention provides methods of making BPXTEN compositions to improve ease of manufacture, result in increased stability, increased water solubility, and/or ease of formulation, as compared to the native BPs. In one embodiment, the invention includes a method of increasing the water solubility of a BP comprising the step of linking the BP to one or more XTEN such that a higher concentration in soluble form of the resulting BPXTEN can be achieved, under physiologic conditions, compared to the BP in an un-fused state. Factors that contribute to the property of XTEN to confer increased water solubility of BPs when incorporated into a fusion protein include the high solubility of the XTEN fusion partner and the low degree of self-aggregation between molecules of XTEN in solution. In some embodiments, the method results in a BPXTEN fusion protein wherein the water solubility is at least about 50%, or at least about 60% greater, or at least about 70% greater, or at least about 80% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater, or at least about 4000% greater, or at least about 6000% greater under physiologic conditions, compared to the un-fused BP.

In another embodiment, the invention includes a method of enhancing the shelf-life of a BP comprising the step of linking the BP with one or more XTEN selected such that the shelf-life of the resulting BPXTEN is extended compared to the BP in an un-fused state. As used herein, shelf-life refers to the period of time over which the functional activity of a BP or BPXTEN that is in solution or in some other storage formulation remains stable without undue loss of activity. As used herein, "functional activity" refers to a pharmacologic effect or biological activity, such as the ability to bind a receptor or ligand, or an enzymatic activity, or to display one or more known functional activities associated with a BP, as known in the art. A BP that degrades or aggregates generally has reduced functional activity or reduced bioavailability compared to one that remains in solution. Factors that contribute to the ability of the method to extend the shelf life of BPs when incorporated into a fusion protein include the increased water solubility, reduced self-aggregation in solution, and increased heat stability of the XTEN fusion partner. In particular, the low tendency of XTEN to aggregate facilitates methods of formulating pharmaceutical preparations containing higher drug concentrations of BPs, and the heat-stability of XTEN contributes to the property of BPXTEN fusion proteins to remain soluble and functionally active for extended periods. In one embodiment, the method results in BPXTEN fusion proteins with "prolonged" or "extended" shelf-life that exhibit greater activity relative to a standard that has been subjected to the same storage and handling conditions. The standard may be the un-fused full-length BP. In one embodiment, the method includes the step of formulating the isolated BPXTEN with one or more pharmaceutically acceptable excipients that enhance the ability of the XTEN to retain its unstructured conformation and for the BPXTEN to remain soluble in the formulation for a time that is greater than that of the corresponding un-fused BP. In one embodiment, the method encompasses linking a BP to an XTEN to create a BPXTEN fusion protein results in a solution that retains greater than about 100% of the functional activity, or greater than about 105%, 110%, 120%, 130%, 150% or 200% of the functional activity of a standard when compared at a given time point and when subjected to the same storage and handling conditions as the standard, thereby enhancing its shelf-life.

Shelf-life may also be assessed in terms of functional activity remaining after storage, normalized to functional activity when storage began. BPXTEN fusion proteins of the invention with prolonged or extended shelf-life as exhibited by prolonged or extended functional activity may retain about 50% more functional activity, or about 60%, 70%, 80%, or 90% more of the functional activity of the equivalent BP not linked to XTEN when subjected to the same conditions for the same period of time. For example, a BPXTEN fusion protein of the invention comprising exendin-4 or glucagon fused to a XTEN sequence may retain about 80% or more of its original activity in solution for periods of up to 5 weeks or more under various temperature conditions. In some embodiments, the BPXTEN retains at least about 50%, or about 60%, or at least about 70%, or at least about 80%, and most preferably at least about 90% or more of its original activity in solution when heated at 80° C. for 10 min. In other embodiments, the BPXTEN retains at least about 50%, preferably at least about 60%, or at least about 70%, or at least about 80%, or alternatively at least about 90% or more of its original activity in solution when heated or maintained at 37° C. for about 7 days. In another embodiment, BPXTEN fusion protein retains at least about 80% or more of its functional activity after exposure to a temperature of about 30° C. to about 70° C. over a period of time of about one hour to about 18 hours. In the foregoing embodiments hereinabove described in this paragraph, the retained activity of the BPXTEN would be at least about two-fold, or at least about three-fold, or at least about four-fold, or at least about five-fold, or at least about six-fold greater at a given time point than that of the corresponding BP not linked to the fusion protein.

VI). The DNA Sequences of the Invention

The present invention provides isolated polynucleic acids encoding BPXTEN chimeric polypeptides and sequences complementary to polynucleic acid molecules encoding BPXTEN chimeric polypeptides, including homologous variants. In another aspect, the invention encompasses methods to produce polynucleic acids encoding BPXTEN chimeric polypeptides and sequences complementary to polynucleic acid molecules encoding BPXTEN chimeric polypeptides, including homologous variants. In general, and as illustrated in FIGS. 4-6, the methods of producing a polynucleotide sequence coding for a BPXTEN fusion protein and expressing the resulting gene product include assembling nucleotides encoding BP and XTEN, linking the components in frame, incorporating the encoding gene into an appropriate expression vector, transforming an appropriate host cell with the expression vector, and causing the fusion protein to be expressed in the transformed host cell, thereby producing the biologically-active BPXTEN polypeptide. Standard recombinant techniques in molecular biology can be used to make the polynucleotides and expression vectors of the present invention.

In accordance with the invention, nucleic acid sequences that encode BPXTEN may be used to generate recombinant DNA molecules that direct the expression of BPXTEN fusion proteins in appropriate host cells. Several cloning strategies are envisioned to be suitable for performing the present invention, many of which can be used to generate a construct that comprises a gene coding for a fusion protein of the BPXTEN composition of the present invention, or its complement. In one embodiment, the cloning strategy would be used to create a gene that encodes a monomeric BPXTEN that comprises at least a first BP and at least a first XTEN polypeptide, or its complement. In another embodiment, the cloning strategy would be used to create a gene that encodes a monomeric BPXTEN that comprises a first and a second molecule of the one BP and at least a first XTEN (or its complement) that would be used to transform a host cell for expression of the fusion protein used to formulate a BPXTEN composition. In the foregoing embodiments hereinabove described in this paragraph, the gene can further comprise nucleotides encoding spacer sequences that may also encode cleavage sequence(s).

In designing a desired XTEN sequences, it was discovered that the non-repetitive nature of the XTEN of the inventive compositions can be achieved despite use of a "building block" molecular approach in the creation of the XTEN-encoding sequences. This was achieved by the use of a library of polynucleotides encoding sequence motifs that are then multimerized to create the genes encoding the XTEN sequences (see FIGS. 4 and 5). Thus, while the expressed XTEN may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to BPXTEN fusion protein. DNA encoding the BP of the compositions may be obtained from a cDNA library prepared using standard methods from tissue or isolated cells believed to possess BP mRNA and to express it at a detectable level. If necessary, the coding sequence can be obtained using conventional primer extension procedures as described in Sambrook, et al., supra, to detect precursors and processing intermediates of mRNA that may not have been reverse-transcribed into cDNA. Accordingly, DNA can be conveniently obtained from a cDNA library prepared from such sources. The BP encoding gene(s) may also be obtained from a genomic library or created by standard synthetic procedures known in the art (e.g., automated nucleic acid synthesis) using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the BAP or of a fragment or variant of the BAP. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the BP encoding gene encodes a protein from any one of Tables 3-8, or a fragment or variant thereof.

A gene or polynucleotide encoding the BP portion of the subject BPXTEN protein, in the case of an expressed fusion protein that will comprise a single BP can be then be cloned into a construct, which can be a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the BP gene by cloning it into the construct adjacent and in frame with the gene(s) coding for the BP. This second step can occur through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension. XTEN polypeptides can be constructed such that the XTEN-encoding gene has low repetitiveness while the encoded amino acid sequence has a degree of repetitiveness. Genes encoding XTEN with non-repetitive sequences can be assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 4 and 5. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage.

Polynucleotide Libraries

In another aspect, the invention provides libraries of polynucleotides that encode XTEN sequences that can be used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes 12 amino acids can be dimerized into a library of polynucleotides that encode 36 amino acids. In turn, the library of polynucleotides that encode 36 amino acids can be serially dimerized into a library containing successively longer lengths of polynucleotides that encode XTEN sequences. In some embodiments, libraries can be assembled of polynucleotides that encode amino acids that are limited to specific sequence XTEN families; e.g., AD, AE, AF, AG, AM, or AQ sequences of Table 1. In other embodiments, libraries can comprises sequences that encode two or more of the motif family sequences from Table 1. The names and sequences of representative, non-limiting polynucleotide sequences of libraries that encode 36mers are presented in Tables 12-15, and the methods used to create them are described more fully in the Examples. The libraries can be used, in turn, for serial dimerization or ligation to achieve polynucleotide sequence libraries that encode XTEN sequences, for example, of 72, 144, 288, 576, 864, 912, 923, 1296 amino acids, or up to a total length of about 3000 amino acids, as well as intermediate lengths. In some cases, the polynucleotide library sequences may also include additional bases used as "sequencing islands," described more fully below.

FIG. 5 is a schematic flowchart of representative, non-limiting steps in the assembly of a XTEN polynucleotide construct and a BPXTEN polynucleotide construct in the embodiments of the invention. Individual oligonucleotides 501 can be annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector can optionally encode a Flag sequence 506 followed by a stuffer sequence that is flanked by BsaI, BbsI, and KpnI sites 507 and, in this case, a single BP gene (encoding exendin-4 in this example) 508, resulting in the gene encoding a BPXTEN comprising a single BP 500. A non-exhaustive list of the XTEN names and SEQ ID NOS. for polynucleotides encoding XTEN and precursor sequences is provided in Table 11.

TABLE 11

DNA sequences of XTEN and precursor sequences

| XTEN Name | SEQ ID NO: | DNA Sequence |
|---|---|---|
| AE144 | 247 | GGTAGCGAACCGGCAACTTCCGGCTCTGAAACCCCAGGTACTTCTGAAAGCGCT<br>ACTCCTGAGTCTGGCCCAGGTAGCGAACCTGCTACCTCTGGCTCTGAAACCCCAG<br>GTAGCCCGGCAGGCTCTCCGACTTCCACCGAGGAAGGTACCTCTACTGAACCTTC<br>TGAGGGTAGCGCTCCAGGTAGCGAACCGGCAACCTCTGGCTCTGAAACCCCAGG<br>TAGCGAACCTGCTACCTCCGGCTCTGAAACTCCAGGTAGCGAACCGGCTACTTCC<br>GGTTCTGAAACTCCAGGTACCTCTACCGAACCTTCCGAAGGCAGCGCACCAGGTA<br>CTTCTGAAAGCGCAACCCCTGAATCCGGTCCAGGTAGCGAACCGGCTACTTCTGG<br>CTCTGAGACTCCAGGTACTTCTACCGAACCGTCCGAAGGTAGCGCACCA |
| AF144 | 248 | GGTACTTCTACTCCGGAAAGCGGTTCCGCATCTCCAGGTACTTCTCCTAGCGGTG<br>AATCTTCTACTGCTCCAGGTACCTCTCCTAGCGGCGAATCTTCTACTGCTCCAGGT<br>TCTACCAGCTCTACCGCTGAATCTCCTGGCCCAGGTTCTACCAGCGAATCCCCGT<br>CTGGCACCGCACCAGGTTCTACTAGCTCTACCGCAGAATCTCCGGGTCCAGGTAC<br>TTCCCCTAGCGGTGAATCTTCTACTGCTCCAGGTACCTCTACTCCGGAAAGCGGC<br>TCCGCATCTCCAGGTTCTACTAGCTCTACTGCTGAATCTCCTGGTCCAGGTACCTC<br>CCCTAGCGGCGAATCTTCTACTGCTCCAGGTACCTCTCCTAGCGGCGAATCTTCT<br>ACCGCTCCAGGTACCTCCCCTAGCGGTGAATCTTCTACCGCACCA |
| AE288 | 249 | GGTACCTCTGAAAGCGCAACTCCTGAGTCTGGCCCAGGTAGCGAACCTGCTACCT<br>CCGGCTCTGAGACTCCAGGTACCTCTGAAAGCGCAACCCCGGAATCTGGTCCAG<br>GTAGCGAACCTGCAACCTCTGGCTCTGAAACCCCAGGTACCTCTGAAAGCGCTAC<br>TCCTGAATCTGGCCCAGGTACTTCTACTGAACCGTCCGAGGGCAGCGCACCAGGT<br>AGCCCTGCTGGCTCTCCAACCTCCACCGAAGAAGGTACCTCTGAAAGCGCAACCC<br>CTGAATCCGGCCCAGGTAGCGAACCGGCAACCTCCGGTTCTGAAACCCCAGGTA<br>CTTCTGAAAGCGCTACTCCTGAGTCCGGCCCAGGTAGCCCGGCTGGCTCTCCGAC<br>TTCCACCGAGGAAGGTAGCCCGGCTGGCTCTCCAACTTCTACTGAAGAAGGTACT<br>TCTACCGAACCTTCCGAGGGCAGCGCACCAGGTACTTCTGAAAGCGCTACCCCTG<br>AGTCCGGCCCAGGTACTTCTGAAAGCGCTACTCCTGAATCCGGTCCAGGTACTTC<br>TGAAAGCGCTACCCCGGAATCTGGCCCAGGTAGCGAACCGGCTACTTCTGGTTCT<br>GAAACCCCAGGTAGCGAACCGGCTACCTCCGGTTCTGAAACTCCAGGTAGCCCA<br>GCAGGCTCTCCGACTTCCACTGAGGAAGGTACTTCTACTGAACCTTCCGAAGGCA<br>GCGCACCAGGTACCTCTACTGAACCTTCTGAGGGCAGCGCTCCAGGTAGCGAAC<br>CTGCAACCTCTGGCTCTGAAACCCCAGGTACCTCTGAAAGCGCTACTCCTGAATC<br>TGGCCCAGGTACTTCTACTGAACCGTCCGAGGGCAGCGCACCA |
| AE576 | 250 | GGTAGCCCGGCTGGCTCTCCTACCTCTACTGAGGAAGGTACTTCTGAAAGCGCTA<br>CTCCTGAGTCTGGTCCAGGTACCTCTACTGAACCGTCCGAAGGTAGCGCTCCAGG<br>TAGCCCAGCAGGCTCTCCGACTTCCACTGAGGAAGGTACTTCTACTGAACCTTCC<br>GAAGGCAGCGCACCAGGTACCTCTACTGAACCTTCTGAGGGCAGCGCTCCAGGT<br>ACTTCTGAAAGCGCTACCCCGGAATCTGGCCCAGGTAGCGAACCGGCTACTTCTG<br>GTTCTGAAACCCCAGGTAGCGAACCGGCTACCTCCGGTTCTGAAACTCCAGGTAG<br>CCCGGCAGGCTCTCCGACCTCTACTGAGGAAGGTACTTCTGAAAGCGCAACCCCG<br>GAGTCCGGCCCAGGTACCTCTACCGAACCGTCTGAGGGCAGCGCACCAGGTACT<br>TCTACCGAACCGTCCGAGGGTAGCGCACCAGGTAGCCCAGCAGGTTCTCCTACCT<br>CCACCGAGGAAGGTACTTCTACCGAACCGTCCGAGGGTAGCGCACCAGGTACCT<br>CTACTGAACCTTCTGAGGGCAGCGCTCCAGGTACTTCTGAAAGCGCTACCCCGGA<br>GTCCGGTCCAGGTACTTCTACTGAACCGTCCGAAGGTAGCGCACCAGGTACTTCT<br>GAAAGCGCAACCCCTGAATCCGGTCCAGGTAGCGAACCGGCTACTTCTGGCTCTG<br>AGACTCCAGGTACTTCTACCGAACCGTCGAAGGTAGCGCACCAGGTACTTCTAC<br>TGAACCGTCTGAAGGTAGCGCACCAGGTACTTCTGAAAGCGCAACCCCGGAATC<br>CGGCCCAGGTACCTCTGAAAGCGCAACCCCGGAGTCCGGCCCAGGTAGCCCTGC<br>TGGCTCTCCAACCTCCACCGAAGAAGGTACCTCTGAAAGCGCAACCCCTGAATCC<br>GGCCCAGGTAGCGAACCGGCAACCTCCGGTTCTGAAACCCCAGGTACCTCTGAA<br>AGCGCTACTCCGGAGTCTGGCCCAGGTACCTCTACTGAACCGTCTGAGGGTAGCG<br>CTCCAGGTACTTCTACTGAACCGTCCGAAGGTAGCGCACCAGGTACTTCTACCGA<br>ACCGTCCGAAGGCAGCGCTCCAGGTACCTCTACTGAACCTTCCGAGGGCAGCGCT<br>CCAGGTACCTCTACCGAACCTTCTGAAGGTAGCGCACCAGGTACTTCTACCGAAC<br>CGTCCGAGGGTAGCGCACCAGGTAGCCCAGCAGGTTCTCCTACCTCCACCGAGG<br>AAGGTACTTCTACCGAACCGTCCGAGGGTAGCGCACCAGGTACCTCTGAAAGCG<br>CAACTCCTGAGTCTGGCCCAGGTAGCGAACCTGCTACCTCCGGCTCTGAGACTCC<br>AGGTACCTCTGAAAGCGCAACCCCGGAATCTGGTCCAGGTAGCGAACCTGCAAC<br>CTCTGGCTCTGAAACCCCAGGTACCTCTGAAAGCGCTACTCCTGAATCTGGCCCA<br>GGTACTTCTACTGAACCGTCCGAGGGCAGCGCACCAGGTACTTCTGAAAGCGCTA<br>CTCCTGAGTCCGGCCCAGGTAGCCCGGCTGGCTCTCCGACTTCCACCGAGGAAGG<br>TAGCCCGGCTGGCTCTCCAACTTCTACTGAAGAAGGTAGCCCGGCAGGCTCTCCG<br>ACCTCTACTGAGGAAGGTACTTCTGAAAGCGCAACCCCGGAGTCCGGCCCAGGT<br>ACCTCTACCGAACCGTCTGAGGGCAGCGCACCA |
| AF576 | 251 | GGTTCTACTAGCTCTACCGCTGAATCTCCTGGCCCAGGTTCCACTAGCTCTACCGC<br>AGAATCTCCGGGCCCAGGTTCTACTAGCGAATCCCCTTCTGGTACCGCTCCAGGT<br>TCTACTAGCTCTACCGCTGAATCTCCGGGTCCAGGTTCTACCAGCTCTACTGCAG<br>AATCTCCTGGCCCAGGTACTTCTACTCCGGAAAGCGGTTCCGCTTCTCCAGGTTCT<br>ACCAGCGAATCTCCTTCTGGCACCGCTCCAGGTACCTCTCCTAGCGGCGAATCTT<br>CTACCGCTCCAGGTTCTACTAGCGAATCTCCTTCTGGCACTGCACCAGGTTCTACC<br>AGCGAATCTCCTTCTGGCACCGCTCCAGGTACCTCTCCTAGCGGCGAATCTTCTA |

TABLE 11-continued

DNA sequences of XTEN and precursor sequences

| XTEN Name | SEQ ID NO: | DNA Sequence |
|---|---|---|
| | | CCGCTCCAGGTTCTACTAGCGAATCTCCTTCTGGCACTGCACCAGGTTCTACCAG<br>CGAATCTCCTTCTGGCACCGCTCCAGGTACCTCTCCTAGCGGCGAATCTTCTACC<br>GCTCCAGGTTCTACTAGCGAATCTCCTTCTGGCACTGCACCAGGTTCTACTAGCG<br>AATCTCCTTCTGGCACTGCACCAGGTTCTACCAGCGAATCTCCGTCTGGCACTGC<br>ACCAGGTACCTCTACCCCTGAAAGCGGTTCCGCTTCTCCAGGTTCTACTAGCGAA<br>TCTCCTTCTGGTACCGCTCCAGGTACTTCTACCCCTGAAAGCGGCTCCGCTTCTCC<br>AGGTTCCACTAGCTCTACCGCTGAATCTCCGGGTCCAGGTTCTACTAGCTCTACT<br>GCAGAATCTCCTGGCCCAGGTACCTCTACTCCGGAAAGCGGCTCTGCATCTCCAG<br>GTACTTCTACCCCTGAAAGCGGTTCTGCATCTCCAGGTTCTACTAGCGAATCCCC<br>GTCTGGTACCGCACCAGGTACTTCTACCCCGGAAAGCGGCTCTGCTTCTCCAGGT<br>ACTTCTACCCCGGAAAGCGGCTCCGCATCTCCAGGTTCTACTAGCGAATCTCCTT<br>CTGGTACCGCTCCAGGTTCTACCAGCGAATCCCCGTCTGGTACTGCTCCAGGTTC<br>TACCAGCGAATCTCCTTCTGGTACTGCACCAGGTTCTACTAGCTCTACTGCAGAA<br>TCTCCTGGCCCAGGTACCTCTACTCCGGAAAGCGGCTCTGCATCTCCAGGTACTT<br>CTACCCCTGAAAGCGGTTCTGCATCTCCAGGTTCTACTAGCGAATCTCCTTCTGGC<br>ACTGCACCAGGTTCTACCAGCGAATCTCCGTCTGGCACTGCACCAGGTACCTCTA<br>CCCCTGAAAGCGGTTCCGCTTCTCCAGGTTCTACTAGCGAATCTCCTTCTGGCACT<br>GCACCAGGTTCTACCAGCGAATCTCCGTCTGGCACTGCACCAGGTACCTCTACCC<br>CTGAAAGCGGTTCCGCTTCTCCAGGTACTTCTCCGAGCGGTGAATCTTCTACCGC<br>ACCAGGTTCTACTAGCTCTACCGCTGAATCTCCGGGCCCAGGTACTTCTCCGAGC<br>GGTGAATCTTCTACTGCTCCAGGTTCCACTAGCTCTACTGCTGAATCTCCTGGCCC<br>AGGTACTTCTACTCCGGAAAGCGGTTCCGCTTCTCCAGGTTCTACTAGCGAATCT<br>CCGTCTGGCACCGCACCAGGTTCTACTAGCTCTACTGCAGAATCTCCTGGCCCAG<br>GTACCTCTACTCCGGAAAGCGGCTCTGCATCTCCAGGTACTTCTACCCCTGAAAG<br>CGGTTCTGCATCTCCA |
| AM875 | 252 | GGTACTTCTACTGAACCGTCTGAAGGCAGCGCACCAGGTAGCGAACCGGCTACTT<br>CCGGTTCTGAAACCCCAGGTAGCCCAGCAGGTTCTCCAACTTCTACTGAAGAAGG<br>TTCTACCAGCTCTACCGCAGAATCTCCTGGTCCAGGTACCTCTACTCCGGAAAGC<br>GGCTCTGCATCTCCAGGTTCTACTAGCGAATCTCCTTCTGGCACTGCACCAGGTTC<br>TACTAGCGAATCCCCGTCTGGTACTGCTCCAGGTACTTCTACTCCTGAAAGCGGT<br>TCCGCTTCTCCAGGTACCTCTACTCCGGAAAGCGGTTCTGCATCTCCAGGTAGCG<br>AACCGGCAACCTCCGGCTCTGAAACCCCAGGTACCTCTGAAAGCGCTACTCCTGA<br>ATCCGGCCCAGGTAGCCCGGCAGGTTCTCCGACTTCCACTGAGGAAGGTACCTCT<br>ACTGAACCTTCTGAGGGCAGCGCTCCAGGTACTTCTGAAAGCGCTACCCCGGAGT<br>CCGGTCCAGGTACTTCTACTGAACCGTCCGAAGGTAGCGCACCAGGTACTTCTAC<br>CGAACCGTCCGAGGGTAGCGCACCAGGTAGCCCAGCAGGTTCTCCTACCTCCACC<br>GAGGAAGGTACTTCTACCGAACCGTCCGAGGGTAGCGCACCAGGTACTTCTACC<br>GAACCTTCCGAGGGCAGCGCACCAGGTACTTCTGAAAGCGCTACCCCTGAGTCC<br>GGCCCAGGTACTTCTGAAAGCGCTACTCCTGAATCCGGTCCAGGTACCTCTACTG<br>AACCTTCCGAAGGCAGCGCTCCAGGTACCTCTACCGAACCGTCCGAGGGCAGCG<br>CACCAGGTACTTCTGAAAGCGCAACCCCTGAATCCGGTCCAGGTACTTCTACTGA<br>ACCTTCCGAAGGTAGCGCTCCAGGTAGCGAACCTGCTACTTCTGGTTCTGAAACC<br>CCAGGTAGCCCGGCTGGCTCTCCGACCTCCACCGAGGAAGGTAGCTCTACCCCGT<br>CTGGTGCTACTGGTTCTCCAGGTACTCCGGGCAGCGGTACTGCTTCTTCCTCTCCA<br>GGTAGCTCTACCCCTTCTGGTGCTACTGGCTCTCCAGGTACCTCTACCGAACCGTC<br>CGAGGGTAGCGCACCAGGTACCTCTACTGAACCGTCTGAGGGTAGCGCTCCAGG<br>TAGCGAACCGGCAACCTCCGGTTCTGAAACTCCAGGTAGCCCTGCTGGCTCTCCG<br>ACTTCTACTGAGGAAGGTAGCCCGGCTGGTTCTCCGACTTCTACTGAGGAAGGTA<br>CTTCTACCGAACCTTCCGAAGGTAGCGCTCCAGGTGCAAGCGCAAGCGGCGCGC<br>CAAGCACGGGAGGTACTTCTGAAAGCGCTACTCCTGAGTCCGGCCCAGGTAGCC<br>CGGCTGGCTCTCCGACTTCCACCGAGGAAGGTAGCCGGCTGGCTCTCCAACTTC<br>TACTGAAGAAGGTTCTACCAGCTCTACCGCTGAATCTCCTGGCCCAGGTTCTACT<br>AGCGAATCTCCGTCTGGCACCGCACCAGGTACTTCCCCTAGCGGTGAATCTTCTA<br>CTGCACCAGGTACCCCTGGCAGCGGTACCGCTTCTTCCTCTCCAGGTAGCTCTAC<br>CCCGTCTGGTGCTACTGGCTCTCCAGGTTCTAGCCCGTCTGCATCTACCGGTACCG<br>GCCCAGGTAGCGAACCGGCAACCTCCGGCTCTGAAACTCCAGGTACTTCTGAAA<br>GCGCTACTCCGGAATCCGGCCCAGGTAGCGAACCGGCTACTTCCGGCTCTGAAAC<br>CCAGGTTCCACCAGCTCTACTGCAGAATCTCCGGGCCCAGGTTCTACTAGCTCT<br>ACTGCAGAATCTCCGGGTCCAGGTACTTCTCCTAGCGGCGAATCTTCTACCGCTC<br>CAGGTAGCGAACCGGCAACCTCTGGCTCTGAAACTCCAGGTAGCGAACCTGCAA<br>CCTCCGGCTCTGAAACCCAGGTACTTCTACTGAACCTTCTGAGGGCAGCGCACC<br>AGGTTCTACCAGCTCTACCGCAGAATCTCCTGGTCCAGGTACCTCTACTCCGGAA<br>AGCGGCTCTGCATCTCCAGGTTCTACTAGCGAATCTCCTTCTGGCACTGCACCAG<br>GTACTTCTACCGAACCGTCCGAAGGCAGCGCTCCAGGTACCTCTACTGAACCTTC<br>CGAGGGCAGCGCTCCAGGTACCTCTACCGAACCTTCTGAAGGTAGCGCACCAGG<br>TAGCTCTACTCCGTCTGGTGCAACCGGCTCCCCAGGTTCTAGCCCGTCTGCTTCCA<br>CTGGTACTGGCCCAGGTGCTTCCCGGGCACCAGCTCTACTGGTTCTCAGGTAG<br>CGAACCTGCTACCTCCGGTTCTGAAACCCCAGGTACCTCTGAAAGCGCAACTCCG<br>GAGTCTGGTCCAGGTAGCCCTGCAGGTTCTCCTACCTCCACTGAGGAAGGTAGCT<br>CTACTCCGTCTGGTGCAACCGGCTCCCCAGGTTCTAGCCCGTCTGCTTCCACTGGT<br>ACTGGCCCAGGTGCTTCCCGGGCACCAGCTCTACTGGTTCTCAGGTACCTCTG<br>AAAGCGCTACTCCGGAGTCTGGCCCAGGTACCTCTACTGAACCGTCTGAGGGTAG<br>CGCTCCAGGTACTTCTACTGAACCGTCCGAAGGTAGCGCACCA |

TABLE 11-continued

DNA sequences of XTEN and precursor sequences

| XTEN Name | SEQ ID NO: | DNA Sequence |
|---|---|---|
| AE864 | 253 | GGTAGCCCGGCTGGCTCTCCTACCTCTACTGAGGAAGGTACTTCTGAAAGCGCTA
CTCCTGAGTCTGGTCCAGGTACCTCTACTGAACCGTCCGAAGGTAGCGCTCCAGG
TAGCCCAGCAGGCTCTCCGACTTCCACTGAGGAAGGTACTTCTACTGAACCTTCC
GAAGGCAGCGCACCAGGTACCTCTACTGAACCTTCTGAGGGCAGCGCTCCAGGT
ACTTCTGAAAGCGCTACCCCGGAATCTGGCCCAGGTAGCGAACCGGCTACTTCTG
GTTCTGAAACCCCAGGTAGCGAACCGGCTACCTCCGGTTCTGAAACTCCAGGTAG
CCCGGCAGGCTCTCCGACCTCTACTGAGGAAGGTACTTCTGAAAGCGCAACCCCG
GAGTCCGGCCCAGGTACCTCTACCGAACCGTCTGAGGGCAGCGCACCAGGTACT
TCTACCGAACCGTCCGAGGGTAGCGCACCAGGTAGCCCAGCAGGTTCTCCTACCT
CCACCGAGGAAGGTACTTCTACCGAACCGTCCGAGGGTAGCGCACCAGGTACCT
CTACTGAACCTTCTGAGGGCAGCGCTCCAGGTACTTCTGAAAGCGCTACCCCGGA
GTCCGGTCCAGGTACTTCTACTGAACCGTCCGAAGGTAGCGCACCAGGTACTTCT
GAAAGCGCAACCCCTGAATCCGGTCCAGGTAGCGAACCGGCTACTTCTGGCTCTG
AGACTCCAGGTACTTCTACCGAACCGTCCGAAGGTAGCGCACCAGGTACTTCTAC
TGAACCGTCTGAAGGTAGCGCACCAGGTACTTCTGAAAGCGCAACCCCGGAATC
CGGCCCAGGTACCTCTGAAAGCGCAACCCCGGAGTCCGGCCCAGGTAGCCCTGC
TGGCTCTCCAACCTCCACCGAAGAAGGTACCTCTGAAAGCGCAACCCCTGAATCC
GGCCCAGGTAGCGAACCGGCAACCTCCGGTTCTGAAACCCCAGGTACCTCTGAA
AGCGCTACTCCGGAGTCTGGCCCAGGTACCTCTACTGAACCGTCTGAGGGTAGCG
CTCCAGGTACTTCTACTGAACCGTCCGAAGGTAGCGCACCAGGTACTTCTACCGA
ACCGTCCGAAGGCAGCGCTCCAGGTACCTCTACTGAACCTTCCGAGGGCAGCGCT
CCAGGTACCTCTACCGAACCTTCTGAAGGTAGCGCACCAGGTACTTCTACCGAAC
CGTCCGAGGGTAGCGCACCAGGTAGCCCAGCAGGTTCTCCTACCTCCACCGAGG
AAGGTACTTCTACCGAACCGTCCGAGGGTAGCGCACCAGGTACTCTGAAAGCG
CAACTCCTGAGTCTGGCCCAGGTAGCGAACCTGCTACCTCCGGCTCTGAGACTCC
AGGTACCTCTGAAAGCGCAACCCCGGAATCTGGTCCAGGTAGCGAACCTGCAAC
CTCTGGCTCTGAAACCCCAGGTACCTCTGAAAGCGCTACTCCTGAATCTGGCCCA
GGTACTTCTACTGAACCGTCCGAGGGCAGCGCACCAGGTACTTCTGAAAGCGCTA
CTCCTGAGTCCGGCCAGGTAGCCCGGCTGGCTCTCCGACTTCCACCGAGGAAGG
TAGCCCGGCTGGCTCTCCAACTTCTACTGAAGAAGGTAGCCCGGCAGGCTCTCCG
ACCTCTACTGAGGAAGGTACTTCTGAAAGCGCAACCCCGGAGTCCGGCCCAGGT
ACCTCTACCGAACCGTCTGAGGGCAGCGCACCAGGTACCTCTGAAAGCGCAACT
CCTGAGTCTGGCCAGGTAGCGAACCTGCTACCTCCGGCTCTGAGACTCCAGGTA
CCTCTGAAAGCGCAACCCCGGAATCTGGTCCAGGTAGCGAACCTGCAACCTCTG
GCTCTGAAACCCCAGGTACCTCTGAAAGCGCTACTCCTGAATCTGGCCCAGGTAC
TTCTACTGAACCGTCCGAGGGCAGCGCACCAGGTAGCCCTGCTGGCTCTCCAACC
TCCACCGAAGAAGGTACCTCTGAAAGCGCAACCCCTGAATCCGGCCCAGGTAGC
GAACCGGCAACCTCCGGTTCTGAAACCCCAGGTACTTCTGAAAGCGCTACTCCTG
AGTCCGGCCCAGGTAGCCCGGCTGGCTCTCCGACTTCCACCGAGGAAGGTAGCC
CGGCTGGCTCTCCAACTTCTACTGAAGAAGGTACTTCTACCGAACCTTCCGAGGG
CAGCGCACCAGGTACTTCTGAAAGCGCTACCCCTGAGTCCGGCCCAGGTACTTCT
GAAAGCGCTACTCCTGAATCCGGTCCAGGTACTTCTGAAAGCGCTACCCCGGAAT
CTGGCCCAGGTAGCGAACCGGCTACTTCTGGTTCTGAAACCCCAGGTAGCGAACC
GGCTACCTCCGGTTCTGAAACTCCAGGTAGCCCAGCAGGCTCTCCGACTTCCACT
GAGGAAGGTACTTCTACTGAACCTTCCGAAGGCAGCGCACCAGGTACCTCTACTG
AACCTTCTGAGGGCAGCGCTCCAGGTAGCGAACCTGCAACCTCTGGCTCTGAAAC
CCCAGGTACCTCTGAAAGCGCTACTCCTGAATCTGGCCCAGGTACTTCTACTGAA
CCGTCCGAGGGCAGCGCACCA |
| AF864 | 254 | GGTTCTACCAGCGAATCTCCTTCTGGCACCGCTCCAGGTACCTCTCCTAGCGGCG
AATCTTCTACCGCTCCAGGTTCTACTAGCGAATCTCCTTCTGGCACTGCACCAGGT
TCTACTAGCGAATCCCCGTCTGGTACTGCTCCAGGTACTTCTACTCCTGAAAGCG
GTTCCGCTTCTCCAGGTACCTCTACTCCGGAAAGCGGTTCTGCATCTCCAGGTTCT
ACCAGCGAATCTCCTTCTGGCACCGCTCCAGGTTCTACTAGCGAATCCCCGTCTG
GTACCGCACCAGGTACTTCTCCTAGCGGCGAATCTTCTACCGCACCAGGTTCTAC
TAGCGAATCTCCGTCTGGCACTGCTCCAGGTACTTCTCCTAGCGGTGAATCTTCTA
CCGCTCCAGGTACTTCCCCTAGCGGCGAATCTTCTACCGCTCCAGGTTCTACTAG
CTCTACTGCAGAATCTCCGGGCCCAGGTACCTCTCCTAGCGGTGAATCTTCTACC
GCTCCAGGTACTTCTCCGAGCGGTGAATCTTCTACCGCTCCAGGTTCTACTAGCTC
TACTGCAGAATCTCCTGGCCCAGGTACCTCTACTCCGGAAAGCGGCTCTGCATCT
CCAGGTACTTCTACCCCTGAAAGCGGTTCTGCATCTCCAGGTTCTACTAGCGAAT
CTCCTTCTGGCACTGCACCAGGTTCTACCAGCGAATCTCCGTCTGGCACTGCACC
AGGTACCTCTACCCCTGAAAGCGGTTCCGCTTCTCCAGGTTCTACCAGCTCTACC
GCAGAATCTCCTGGTCCAGGTACCTCTACTCCGGAAAGCGGCTCTGCATCTCCAG
GTTCTACTAGCGAATCTCCTTCTGGCACTGCACCAGGTACTTCTCCGAGCGGTGA
ATCTTCTACCGCACCAGGTTCTACTAGCTCTACCGCTGAATCTCCGGGCCCAGGT
ACTTCTCCGAGCGGTGAATCTTCTACTGCTCCAGGTACCTCTACTCCTGAAAGCG
GTTCTGCATCTCCAGGTTCCACTAGCTCTACCGCAGAATCTCCGGGCCCAGGTTC
TACTAGCTCTACTGCTGAATCTCCTGGCCCAGGTTCTACTAGCTCTACTGCTGAAT
CTCCGGGTCCAGGTTCTACCAGCTCTACTGCTGAATCTCCTGGTCCAGGTACCTCC
CCGAGCGGTGAATCTTCTACTGCACCAGGTTCTACTAGCGAATCTCCTTCTGGCA
CTGCACCAGGTTCTACCAGCGAATCCGTCTGGCACTGCACCAGGTACCTCTAC
CCCTGAAAGCGGTCCXXXXXXXXXXXXXTGCAAGCGCAAGCGGCGCGCCAAGCA
CGGGAXXXXXXXXXTAGCGAATCTCCTTTCTGGTACCGCTCCAGGTTCTACCAGCG
AATCCCCGTCTGGTACTGCTCCAGGTTCTACCAGCGAATCTCCTTCTGGTACTGCA |

TABLE 11-continued

DNA sequences of XTEN and precursor sequences

| XTEN Name | SEQ ID NO: | DNA Sequence |
|---|---|---|
| | | CCAGGTTCTACTAGCGAATCTCCTTCTGGTACCGCTCCAGGTTCTACCAGCGAAT CCCCGTCTGGTACTGCTCCAGGTTCTACCAGCGAATCTCCTTCTGGTACTGCACCA GGTACTTCTACTCCGGAAAGCGGTTCCGCATCTCCAGGTACTTCTCCTAGCGGTG AATCTTCTACTGCTCCAGGTACCTCTCCTAGCGGCGAATCTTCTACTGCTCCAGGT TCTACCAGCTCTACTGCTGAATCTCCGGGTCCAGGTACTTCCCCGAGCGGTGAAT CTTCTACTGCACCAGGTACTTCTACTCCGGAAAGCGGTTCCGCTTCTCCAGGTTCT ACCAGCGAATCTCCTTCTGGCACCGCTCCAGGTTCTACTAGCGAATCCCCGTCTG GTACCGCACCAGGTACTTCTCCTAGCGGCGAATCTTCTACCGCACCAGGTTCTAC TAGCGAATCCCCGTCTGGTACCGCACCAGGTACTTCTACCCCGGAAAGCGGCTCT GCTTCTCCAGGTACTTCTACCCCGGAAAGCGGCTCCGCATCTCCAGGTTCTACTA GCGAATCTCCTTCTGGTACCGCTCCAGGTACTTCTACCCCTGAAAGCGGCTCCGC TTCTCCAGGTTCCACTAGCTCTACCGCTGAATCTCCGGGTCCAGGTTCTACCAGC GAATCTCCTTCTGGCACCGCTCCAGGTTCTACTAGCGAATCCCCGTCTGGTACCG CACCAGGTACTTCTCCTAGCGGCGAATCTTCTACCGCACCAGGTTCTACCAGCTC TACTGCTGAATCTCCGGGTCCAGGTACTTCCCCGAGCGGTGAATCTTCTACTGCA CCAGGTACTTCTACTCCGGAAAGCGGTTCCGCTTCTCCAGGTACCTCCCCTAGCG GCGAATCTTCTACTGCTCCAGGTACCTCTCCTAGCGGCGAATCTTCTACCGCTCCA GGTACCTCCCTAGCGGTGAATCTTCTACCGCACCAGGTTCTACTAGCTCTACTG CTGAATCTCCGGGTCCAGGTTCTACCAGCTCTACTGCTGAATCTCCTGGTCCAGG TACCTCCCCGAGCGGTGAATCTTCTACTGCACCAGGTTCTAGCCCTTCTGCTTCCA CCGGTACCGGCCCAGGTAGCTCTACTCCGTCTGGTGCAACTGGCTCTCCAGGTAG CTCTACTCCGTCTGGTGCAACCGGCTCCCCA XXXX was inserted in two areas where no sequence information is available. |
| AG864 | 255 | GGTGCTTCCCCGGGCACCAGCTCTACTGGTTCTCCAGGTTCTAGCCCGTCTGCTTC TACTGGTACTGGTCCAGGTTCTAGCCCTTCTGCTTCCACTGGTACTGGTCCAGGTA CCCCGGGTAGCGGTACCGCTTCTTCTTCTCCAGGTAGCTCTACTCCGTCTGGTGCT ACCGGCTCTCCAGGTTCTAACCCTTCTGCATCCACCGGTACCGGCCCAGGTGCTT CTCCGGGCACCAGCTCTACTGGTTCTCCAGGTACCCCGGGCAGCGGTACCGCATC TTCTTCTCCAGGTAGCTCTACTCCTTCTGGTGCAACTGGTTCTCCAGGTACTCCTG GCAGCGGTACCGCTTCTTCTTCTCCAGGTGCTTCTCCTGGTACTAGCTCTACTGGT TCTCCAGGTGCTTCTCCGGGCACTAGCTCTACTGGTTCTCCAGGTACCCCGGGTA GCGGTACTGCTTCTTCCTCTCCAGGTAGCTCTACCCCTTCTGGTGCAACCGGCTCT CCAGGTGCTTCTCCGGGCACCAGCTCTACCGGTTCTCCAGGTACCCCGGGTAGCG GTACCGCTTCTTCTTCTCCAGGTAGCTCTACTCCGTCTGGTGCTACCGGCTCTCCA GGTTCTAACCCTTCTGCATCCACCGGTACCGGCCCAGGTTCTAGCCCTTCTGCTTC CACCGGTACTGGCCCAGGTAGCTCTACCCCTTCTGGTGCTACCGGCTCCCCAGGT AGCTCTACTCCTTCTGGTGCAACTGGCTCTCCAGGTGCATCTCCGGGCACTAGCT CTACTGGTTCTCCAGGTGCATCCCCTGGCACTAGCTCTACTGGTTCTCCAGGTGCT TCTCCTGGTACCAGCTCTACTGGTTCTCCAGGTACTCCTGGCAGCGGTACCGCTTC TTCTTCTCCAGGTGCTTCTCCTGGTACTAGCTCTACTGGTTCTCCAGGTGCTTCTC CGGGCACTAGCTCTACTGGTTCTCCAGGTGCTTCCCCGGGCACTAGCTCTACCGG TTCTCCAGGTTCTAGCCCTTCTGCATCTACTGGTACTGGCCCAGGTACTCCGGGCA GCGGTACTGCTTCTTCCTCTCCAGGTGCATCTCCGGGCACTAGCTCTACTGGTTCT CCAGGTGCATCCCCTGGCACTAGCTCTACTGGTTCTCCAGGTGCTTCTCCTGGTAC CAGCTCTACTGGTTCTCCAGGTAGCTCTACTCCGTCTGGTGCAACCGGTTCCCCA GGTAGCTCTACTCCTTCTGGTGCTACTGGCTCCCCAGGTGCATCCCCTGGCACCA GCTCTACCGGTTCTCCAGGTACCCCGGGCAGCGGTACCGCATCTTCCTCTCCAGG TAGCTCTACCCCGTCTGGTGCTACCGGTTCCCCAGGTAGCTCTACCCCGTCTGGTG CAACCGGCTCCCCAGGTAGCTCTACTCCGTCTGGTGCAACCGGCTCCCCAGGTTC TAGCCCGTCTGCTTCCACTGGTACTGGCCCAGGTGCTTCCCGGGCACCAGCTCT ACTGGTTCTCCAGGTGCATCCCCGGGTACCAGCTCTACCGGTTCTCCAGGTACTC CTGGCAGCGGTACTGCATCTTCCTCTCCAGGTGCTTCTCCGGGCACCAGCTCTACT GGTTCTCCAGGTGCATCTCCGGGCACTAGCTCTACTGGTTCTCCAGGTGCATCCC CTGGCACTAGCTCTACTGGTTCTCCAGGTGCTTCTCCTGGTACCAGCTCTACTGGT TCTCCAGGTACCCCTGGTAGCGGTACTGCTTCTTCCTCTCCAGGTAGCTCTACTCC GTCTGGTGCTACCGGTTCTCCAGGTACCCCGGGTAGCGGTACCGCATCTTCTTCTC CAGGTAGCTCTACCCCGTCTGGTGCTACTGGTTCTCCAGGTACTCCGGGCAGCGG TACTGCTTCTTCCTCTCCAGGTAGCTCTACCCCTTCTGGTGCTACTGGCTCTCCAG GTAGCTCTACCCCGTCTGGTGCTACTGGCTCCCCAGGTTCTAGCCCTTCTGCATCC ACCGGTACCGGTCCAGGTTCTAGCCCGTCTGCATCTACTGGTACTGGTCCAGGTG CATCCCCGGGCACTAGCTCTACCGGTTCTCCAGGTACTCCTGGTAGCGGTACTGC TTCTTCTTCTCCAGGTAGCTCTACTCCTTCTGGTGCTACTGGTTCTCCAGGTTCTA GCCCTTCTGCATCCACCGGTACCGGCCCAGGTTCTAGCCCGTCTGCTTCTACCGGT ACTGGTCCAGGTGCTTCTCCGGGTACTAGCTCTACTGGTTCTCCAGGTGCATCTCC TGGTACTAGCTCTACTGGTTCTCCAGGTAGCTCTACTCCGTCTGGTGCAACCGGCT CTCCAGGTTCTAGCCCTTCTGCATCTACCGGTACTGGTCCAGGTGCATCCCCTGGT ACCAGCTCTACCGGTTCTCCAGGTTCTAGCCCTTCTGCTTCTACCGGTACCGGTCC AGGTACCCCTGGCAGCGGTACCGCATCTTCCTCTCCAGGTAGCTCTACTCCGTCT GGTGCAACCGGTTCCCCAGGTAGCTCTACTCCTTCTGGTGCTACTGGCTCCCCAG GTGCATCCCCTGGCACCAGCTCTACCGGTTCTCCA |
| AM923 | 256 | ATGGCTGAACCTGCTGGCTCTCCAACCTCCACTGAGGAAGGTGCATCCCCGGGCA CCAGCTCTACCGGTTCTCCAGGTAGCTCTACCCCCGTCTGGTGCTACCGGCTCTCCA |

TABLE 11-continued

DNA sequences of XTEN and precursor sequences

| XTEN Name | SEQ ID NO: | DNA Sequence |
|---|---|---|
| | | GGTAGCTCTACCCCGTCTGGTGCTACTGGCTCTCCAGGTACTTCTACTGAACCGTC
TGAAGGCAGCGCACCAGGTAGCGAACCGGCTACTTCCGGTTCTGAAACCCCAGG
TAGCCCAGCAGGTTCTCCAACTTCTACTGAAGAAGGTTCTACCAGCTCTACCGCA
GAATCTCCTGGTCCAGGTACCTCTACTCCGGAAAGCGGCTCTGCATCTCCAGGTT
CTACTAGCGAATCTCCTTCTGGCACTGCACCAGGTTCTACTAGCGAATCCCCGTC
TGGTACTGCTCCAGGTACTTCTACTCCTGAAAGCGGTTCCGCTTCTCCAGGTACCT
CTACTCCGGAAAGCGGTTCTGCATCTCCAGGTAGCGAACCGGCAACCTCCGGCTC
TGAAACCCCAGGTACCTCTGAAAGCGCTACTCCTGAATCCGGCCCAGGTAGCCCG
GCAGGTTCTCCGACTTCCACTGAGGAAGGTACCTCTACTGAACCTTCTGAGGGCA
GCGCTCCAGGTACTTCTGAAAGCGCTACCCCGGAGTCCGGTCCAGGTACTTCTAC
TGAACCGTCCGAAGGTAGCGCACCAGGTACTTCTACCGAACCGTCCGAGGGTAG
CGCACCAGGTAGCCCAGCAGGTTCTCCTACCTCCACCGAGGAAGGTACTTCTACC
GAACCGTCCGAGGGTAGCGCACCAGGTACTTCTACCGAACCTTCCGAGGGCAGC
GCACCAGGTACTTCTGAAAGCGCTACCCCTGAGTCCGGCCCAGGTACTTCTGAAA
GCGCTACTCCTGAATCCGGTCCAGGTACCTCTACTGAACCTTCCGAAGGCAGCGC
TCCAGGTACCTCTACCGAACCGTCCGAGGGCAGCGCACCAGGTACTTCTGAAAG
CGCAACCCCTGAATCCGGTCCAGGTACTTCTACTGAACCTTCCGAAGGTAGCGCT
CCAGGTAGCGAACCTGCTACTTCTGGTTCTGAAACCCCAGGTAGCCCGGCTGGCT
CTCCGACCTCCACCGAGGAAGGTAGCTCTACCCCGTCTGGTGCTACTGGTTCTCC
AGGTACTCCGGGCAGCGGTACTGCTTCTTCCTCTCCAGGTAGCTCTACCCCTTCTG
GTGCTACTGGCTCTCCAGGTACCTCTACCGAACCGTCCGAGGGTAGCGCACCAGG
TACCTCTACTGAACCGTCTGAGGGTAGCGCTCCAGGTAGCGAACCGGCAACCTCC
GGTTCTGAAACTCCAGGTAGCCCTGCTGGCTCTCCGACTTCTACTGAGGAAGGTA
GCCCGGCTGGTTCTCCGACTTCTACTGAGGAAGGTACTTCTACCGAACCTTCCGA
AGGTAGCGCTCCAGGTGCAAGCGCAAGCGGCGCGCCAAGCACGGGAGGTACTTC
TGAAAGCGCTACTCCTGAGTCCGGCCCAGGTAGCCCGGCTGGCTCTCCGACTTCC
ACCGAGGAAGGTAGCCCGGCTGGCTCTCCAACTTCTACTGAAGAAGGTTCTACCA
GCTCTACCGCTGAATCTCCTGGCCCAGGTTCTACTAGCGAATCTCCGTCTGGCAC
CGCACCAGGTACTTCCCCTAGCGGTGAATCTTCTACTGCACCAGGTACCCCTGGC
AGCGGTACCGCTTCTTCCTCTCCAGGTAGCTCTACCCCGTCTGGTGCTACTGGCTC
TCCAGGTTCTAGCCCGTCTGCATCTACCGGTACCGGCCCAGGTAGCGAACCGGCA
ACCTCCGGCTCTGAAACTCCAGGTACTTCTGAAAGCGCTACTCCGGAATCCGGCC
CAGGTAGCGAACCGGCTACTTCCGGCTCTGAAACCCAGGTTCCACCAGCTCTAC
TGCAGAATCTCCGGGCCCAGGTTCTACTAGCTCTACTGCAGAATCTCCGGGTCCA
GGTACTTCTCCTAGCGGCGAATCTTCTACCGCTCCAGGTAGCGAACCGGCAACCT
CTGGCTCTGAAACTCCAGGTAGCGAACCTGCAACCTCCGGCTCTGAAACCCCAGG
TACTTCTACTGAACCTTCTGAGGGCAGCGCACCAGGTTCTACCAGCTCTACCGCA
GAATCTCCTGGTCCAGGTACCTCTACTCCGGAAAGCGGCTCTGCATCTCCAGGTT
CTACTAGCGAATCTCCTTCTGGCACTGCACCAGGTACTTCTACCGAACCGTCCGA
AGGCAGCGCTCCAGGTACCTCTACTGAACCTTCCGAGGGCAGCGCTCCAGGTACC
TCTACCGAACCTTCTGAAGGTAGCGCACCAGGTAGCTCTACTCCGTCTGGTGCAA
CCGGCTCCCCAGGTTCTAGCCCGTCTGCTTCCACTGGTACTGGCCCAGGTGCTTCC
CCGGGCACCAGCTCTACTGGTTCTCCAGGTAGCGAACCTGCTACCTCCGGTTCTG
AAACCCCAGGTACCTCTGAAAGCGCAACTCCGGAGTCTGGTCCAGGTAGCCCTG
CAGGTTCTCCTACCTCCACTGAGGAAGGTAGCTCTACTCCGTCTGGTGCAACCGG
CTCCCCAGGTTCTAGCCCGTCTGCTTCCACTGGTACTGGCCCAGGTGCTTCCCCGG
GCACCAGCTCTACTGGTTCTCCAGGTACCTCTGAAAGCGCTACTCCGGAGTCTGG
CCCAGGTACCTCTACTGAACCGTCTGAGGGTAGCGCTCCAGGTACTTCTACTGAA
CCGTCCGAAGGTAGCGCACCA |
| AE912 | 257 | ATGGCTGAACCTGCTGGCTCTCCAACCTCCACTGAGGAAGGTACCCCGGGTAGCG
GTACTGCTTCTTCCTCTCCAGGTAGCTCTACCCCTTCTGGTGCAACCGGCTCTCCA
GGTGCTTCTCCGGGCACCAGCTCTACCGGTTCTCCAGGTAGCCCGGCTGGCTCTC
CTACCTCTACTGAGGAAGGTACTTCTGAAAGCGCTACTCCTGAGTCTGGTCCAGG
TACCTCTACTGAACCGTCCGAAGGTAGCGCTCCAGGTAGCCCAGCAGGCTCTCCG
ACTTCCACTGAGGAAGGTACTTCTACTGAACCTTCCGAAGGCAGCGCACCAGGTA
CCTCTACTGAACCTTCTGAGGGCAGCGCTCCAGGTACTTCTGAAAGCGCTACCCC
GGAATCTGCCCAGGTAGCGAACCGGCTACTTCTGGTTCTGAAACCCCAGGTAGC
GAACCGGCTACCTCCGGTTCTGAAACTCCAGGTAGCCCGGCAGGCTCTCCGACCT
CTACTGAGGAAGGTACTTCTGAAAGCGCAACCCCGGAGTCCGGCCCAGGTACCT
CTACCGAACCGTCTGAGGGCAGCGCACCAGGTACTTCTACCGAACCGTCCGAGG
GTAGCGCACCAGGTAGCCCAGCAGGTTCTCCTACCTCCACCGAGGAAGGTACTTC
TACCGAACCGTCCGAGGGTAGCGCACCAGGTACCTCTACTGAACCTTCTGAGGGC
AGCGCTCCAGGTACTTCTGAAAGCGCTACCCCGGAGTCCGGTCAGGTACTTCTA
CTGAACCGTCCGAAGGTAGCGCACCAGGTACTTCTGAAAGCGCAACCCCTGAAT
CCGGTCCAGGTAGCGAACCGGCTACTTCTGGCTCTGAGACTCCAGGTACTTCTAC
CGAACCGTCCGAAGGTAGCGCACCAGGTACTTCTACTGAACCGTCTGAAGGTAG
CGCACCAGGTACTTCTGAAAGCGCAACCCCGGAATCCGGCCCAGGTACCTCTGA
AAGCGCAACCCCGGAGTCCGGCCCAGGTAGCCCTGCTGGCTCTCCAACCTCCACC
GAAGAAGGTACCTCTGAAAGCGCAACCCCTGAATCCGGCCCAGGTAGCGAACCG
GCAACCTCCGGTTCTGAAACCCCAGGTACCTCTGAAAGCGCTACTCCGGAGTCTG
GCCCAGGTACCTCTACTGAACCGTCTGAGGGTAGCGCTCCAGGTACTTCTACTGA
ACCGTCCGAAGGTAGCGCACCAGGTACTTCTACCGAACCGTCCGAAGGCAGCGC
TCCAGGTACCTCTACTGAACCTTCCGAGGGCAGCGCTCCAGGTACCTCTACCGAA
CCTTCTGAAGGTAGCGCACCAGGTACTTCTACCGAACCGTCCGAGGGTAGCGCAC |

TABLE 11-continued

DNA sequences of XTEN and precursor sequences

| XTEN Name | SEQ ID NO: | DNA Sequence |
|---|---|---|
| | | CAGGTAGCCCAGCAGGTTCTCCTACCTCCACCGAGGAAGGTACTTCTACCGAACC GTCCGAGGGTAGCGCACCAGGTACCTCTGAAAGCGCAACTCCTGAGTCTGGCCC AGGTAGCGAACCTGCTACCTCCGGCTCTGAGACTCCAGGTACCTCTGAAAGCGCA ACCCCGGAATCTGGTCCAGGTAGCGAACCTGCAACCTCTGGCTCTGAAACCCCAG GTACCTCTGAAAGCGCTACTCCTGAATCTGGCCCAGGTACTTCTACTGAACCGTC CGAGGGCAGCGCACCAGGTACTTCTGAAAGCGCTACTCCTGAGTCCGGCCCAGG TAGCCCGGCTGGCTCTCCGACTTCCACCGAGGAAGGTAGCCCGGCTGGCTCTCCA ACTTCTACTGAAGAAGGTAGCCCGGCAGGCTCTCCGACCTCTACTGAGGAAGGT ACTTCTGAAAGCGCAACCCCGGAGTCCGGCCCAGGTACCTCTACCGAACCGTCTG AGGGCAGCGCACCAGGTACCTCTGAAAGCGCAACTCCTGAGTCTGGCCCAGGTA GCGAACCTGCTACCTCCGGCTCTGAGACTCCAGGTACCTCTGAAAGCGCAACCCC GGAATCTGGTCCAGGTAGCGAACCTGCAACCTCTGGCTCTGAAACCCCAGGTACC TCTGAAAGCGCTACTCCTGAATCTGGCCCAGGTACTTCTACTGAACCGTCCGAGG GCAGCGCACCAGGTAGCCCTGCTGGCTCTCCAACCTCCACCGAAGAAGGTACCTC TGAAAGCGCAACCCCTGAATCCGGCCCAGGTAGCGAACCGGCAACCTCCGGTTC TGAAACCCCAGGTACTTCTGAAAGCGCTACTCCTGAGTCCGGCCCAGGTAGCCCG GCTGGCTCTCCGACTTCCACCGAGGAAGGTAGCCCGGCTGGCTCTCCAACTTCTA CTGAAGAAGGTACTTCTACCGAACCTTCCGAGGGCAGCGCACCAGGTACTTCTGA AAGCGCTACCCCTGAGTCCGGCCCAGGTACTTCTGAAAGCGCTACTCCTGAATCC GGTCCAGGTACTTCTGAAAGCGCTACCCCGGAATCTGGCCCAGGTAGCGAACCG GCTACTTCTGGTTCTGAAACCCCAGGTAGCGAACCGGCTACCTCCGGTTCTGAAA CTCCAGGTAGCCCAGCAGGCTCTCCGACTTCCACTGAGGAAGGTACTTCTACTGA ACCTTCCGAAGGCAGCGCACCAGGTACCTCTACTGAACCTTCTGAGGGCAGCGCT CCAGGTAGCGAACCTGCAACCTCTGGCTCTGAAACCCCAGGTACCTCTGAAAGC GCTACTCCTGAATCTGGCCCAGGTACTTCTACTGAACCGTCCGAGGGCAGCGCAC CA |
| AM1296 | 258 | GGTACTTCTACTGAACCGTCTGAAGGCAGCGCACCAGGTAGCGAACCGGCTACTT CCGGTTCTGAAACCCCAGGTAGCCCAGCAGGTTCTCCAACTTCTACTGAAGAAGG TTCTACCAGCTCTACCGCAGAATCTCCTGGTCCAGGTACCTCTACTCCGGAAAGC GGCTCTGCATCTCCAGGTTCTACTAGCGAATCTCCTTCTGGCACTGCACCAGGTTC TACTAGCGAATCCCCGTCTGGTACTGCTCCAGGTACTTCTACTCCTGAAAGCGGT TCCGCTTCTCCAGGTACCTCTACTCCGGAAAGCGGTTCTGCATCTCCAGGTAGCG AACCGGCAACCTCCGGCTCTGAAACCCCAGGTACCTCTGAAAGCGCTACTCCTGA ATCCGGCCCAGGTAGCCCGGCAGGTTCTCCGACTTCCACTGAGGAAGGTACCTCT ACTGAACCTTCTGAGGGCAGCGCTCCAGGTACTTCTGAAAGCGCTACCCCGGAGT CCGGTCCAGGTACTTCTACTGAACCGTCCGAAGGTAGCGCACCAGGTACTTCTAC CGAACCGTCCGAGGGTAGCGCACCAGGTAGCCCAGCAGGTTCTCCTACCTCCACC GAGGAAGGTACTTCTACCGAACCGTCCGAGGGTAGCGCACCAGGTACTTCTACC GAACCTTCCGAGGGCAGCGCACCAGGTACTTCTGAAAGCGCTACCCCTGAGTCC GGCCCAGGTACTTCTGAAAGCGCTACTCCTGAATCCGGTCCAGGTACCTCTACTG AACCTTCCGAAGGCAGCGCTCCAGGTACCTCTACCGAACCGTCCGAGGGCAGCG CACCAGGTACTTCTGAAAGCGCAACCCCTGAATCCGGTCCAGGTACTTCTACTGA ACCTTCCGAAGGTAGCGCTCCAGGTAGCGAACCTGCTACTTCTGGTTCTGAAACC CCAGGTAGCCCGGCTGGCTCTCCGACCTCCACCGAGGAAGGTAGCTCTACCCCGT CTGGTGCTACTGGTTCTCCAGGTACTCCGGGCAGCGGTACTGCTTCTTCCTCTCCA GGTAGCTCTACCCCTTCTGGTGCTACTGGCTCTCCAGGTACCTCTACCGAACCGTC CGAGGGTAGCGCACCAGGTACCTCTACTGAACCGTCTGAGGGTAGCGCTCCAGG TAGCGAACCGGCAACCTCCGGTTCTGAAACTCCAGGTAGCCCTGCTGGCTCTCCG ACTTCTACTGAGGAAGGTAGCCCGGCTGGTTCTCCGACTTCTACTGAGGAAGGTA CTTCTACCGAACCTTCCGAAGGTAGCGCTCCAGGTCCAGAACCAACGGGGCCGG CCCCAAGCGGAGGTAGCGAACCGGCAACCTCCGGCTCTGAAACCCCAGGTACCT CTGAAAGCGCTACTCCTGAATCCGGCCCAGGTAGCCCGGCAGGTTCTCCGACTTC CACTGAGGAAGGTACTTCTGAAAGCGCTACTCCTGAGTCCGGCCCAGGTAGCCC GGCTGGCTCTCCGACTTCCACCGAGGAAGGTAGCCCGGCTGGCTCTCCAACTTCT ACTGAAGAAGGTACTTCTGAAAGCGCTACTCCTGAGTCCGGCCCAGGTAGCCCG GCTGGCTCTCCGACTTCCACCGAGGAAGGTAGCCCGGCTGGCTCTCCAACTTCTA CTGAAGAAGGTTCTACCAGCTCTACCGCGAATCTCCGTCTGGCACCGCACCAGGTACTTCCCCTAGCGGTGAATCTTCTACT GCACCAGGTTCTACCAGCGAATCTCCTTCTGGCACCGCTCCAGGTTCTACTAGCG AATCCCCGTCTGGTACCGCACCAGGTACTTCTCCTAGCGGCGAATCTTCTACCGC ACCAGGTACTTCTACCGAACCTTCCGAGGGCAGCGCTCCAGGTACTTCTGAAAGC GCTACCCCTGAGTCCGGCCCAGGTACTTCTGAAAGCGCTACTCCTGAATCGGTC CAGGTAGCGAACCGGCAACCTCTGGCTCTGAAACCCCAGGTACCTCTGAAAGCG CTACTCCGGAATCTGGTCCAGGTACTTCTGAAAGCGCTACTCCGGAATCCGGTCC AGGTACCTCTACTGAACCTTCTGAGGGCAGCGCTCCAGGTACTTCTGAAAGCGCT ACCCCGGAGTCCGGTCCAGGTACTTCTACTGAACCGTCCGAAGGTAGCGCACCA GGTACCTCCCCTAGCGGCGAATCTTCTACTGCTCCAGGTACCTCTCCTAGCGGCG AATCTTCTACCGCTCCAGGTACCTCCCCTAGCGGTGAATCTTCTACCGCACCAGG TACTTCTACCGAACCGTCCGAGGGTAGCGCACCAGGTAGCGCAGGTTCTCCT ACCTCCACCGAGGAAGGTACTTCTACCGAACCGTCCGAGGGTAGCGCACCAGGT TCTAGCCCTTCTGCTTCCACCGGTACCGGCCCAGGTAGCGCTACTCCGTCTGGTGC AACTGGCTCTCCAGGTAGCTCTACTCCGTCTGGTGCAACCGGCTCCCCAGGTAGC TCTACCCCGTCTGGTGCTACCGGCTCTCCAGGTAGCTCTACCCCGTCTGGTGCAA CCGGCTCCCCAGGTGCATCCCCGGGTACTAGCTCTACCGGTTCTCCAGGTGCAAG |

TABLE 11-continued

DNA sequences of XTEN and precursor sequences

| XTEN Name | SEQ ID NO: | DNA Sequence |
|---|---|---|
| | | CGCAAGCGGCGCGCCAAGCACGGGAGGTACTTCTCCGAGCGGTGAATCTTCTAC<br>CGCACCAGGTTCTACTAGCTCTACCGCTGAATCTCCGGGCCCAGGTACTTCTCCG<br>AGCGGTGAATCTTCTACTGCTCCAGGTACCTCTGAAAGCGCTACTCCGGAGTCTG<br>GCCCAGGTACCTCTACTGAACCGTCTGAGGGTAGCGCTCCAGGTACTTCTACTGA<br>ACCGTCCGAAGGTAGCGCACCAGGTTCTAGCCCTTCTGCATCTACTGGTACTGGC<br>CCAGGTAGCTCTACTCCTTCTGGTGCTACCGGCTCTCCAGGTGCTTCTCCGGGTAC<br>TAGCTCTACCGGTTCTCCAGGTACTTCTACTCCGGAAAGCGGTTCCGCATCTCCA<br>GGTACTTCTCCTAGCGGTGAATCTTCTACTGCTCCAGGTACCTCTCCTAGCGGCG<br>AATCTTCTACTGCTCCAGGTACTTCTGAAAGCGCAACCCCTGAATCCGGTCCAGG<br>TAGCGAACCGGCTACTTCTGGCTCTGAGACTCCAGGTACTTCTACCGAACCGTCC<br>GAAGGTAGCGCACCAGGTTCTACCAGCGAATCCCCTTCTGGTACTGCTCCAGGTT<br>CTACCAGCGAATCCCCTTCTGGCACCGCACCAGGTACTTCTACCCCTGAAAGCGG<br>CTCCGCTTCTCCAGGTAGCCCGGCAGGCTCTCCGACCTCTACTGAGGAAGGTACT<br>TCTGAAAGCGCAACCCCGGAGTCCGGCCCAGGTACCTCTACCGAACCGTCTGAG<br>GGCAGCGCACCAGGTAGCCCTGCTGGCTCTCCAACCTCCACCGAAGAAGGTACC<br>TCTGAAAGCGCAACCCCTGAATCCGGCCCAGGTAGCGAACCGGCAACCTCCGGT<br>TCTGAAACCCCAGGTAGCTCTACCCCGTCTGGTGCTACCGGTTCCCCAGGTGCTT<br>CTCCTGGTACTAGCTCTACCGGTTCTCCAGGTAGCTCTACCCCGTCTGGTGCTACT<br>GGCTCTCCAGGTTCTACTAGCGAATCCCGTCTGGTACTGCTCCAGGTACTTCCCC<br>TAGCGGTGAATCTTCTACTGCTCCAGGTTCTACCAGCTCTACCGCAGAATCTCCG<br>GGTCCAGGTAGCTCTACCCCTTCTGGTGCAACCGGCTCTCCAGGTGCATCCCCGG<br>GTACCAGCTCTACCGGTTCTCCAGGTACTCCGGGTAGCGGTACCGCTTCTTCCTCT<br>CCAGGTAGCCCTGCTGGCTCTCCGACTTCTACTGAGGAAGGTAGCCCGGCTGGTT<br>CTCCGACTTCTACTGAGGAAGGTACTTCTACCGAACCTTCCGAAGGTAGCGCTCCA |
| BC864 | 259 | GGTACTTCCACCGAACCATCCGAACCAGGTAGCGCAGGTACTTCCACCGAACCAT<br>CCGAACCTGGCAGCGCAGGTAGCGAACCGGCAACCTCTGGTACTGAACCATCAG<br>GTAGCGGCGCATCCGAGCCTACCTCTACTGAACCAGGTAGCGAACCGGCTACCTC<br>CGGTACTGAGCCATCAGGTAGCGAACCGGCAACTTCCGGTACTGAACCATCAGG<br>TAGCGAACCGGCAACTTCCGGCACTGAACCATCAGGTAGCGGTGCATCTGAGCC<br>GACCTCTACTGAACCAGGTACTTCTACTGAACCATCTGAGCCGGGCAGCGCAGGT<br>AGCGAACCAGCTACTTCTGGCACTGAACCATCAGGTACTTCTACTGAACCATCCG<br>AACCAGGTAGCGCAGGTAGCGAACCTGCTACCTCTGGTACTGAGCCATCAGGTA<br>GCGAACCGGCTACCTCTGGTACTGAACCATCAGGTACTTCTACCGAACCATCCGA<br>GCCTGGTAGCGCAGGTACTTCTACCGAACCATCCGAGCCAGGCAGCGCAGGTAG<br>CGAACCGGCAACCTCTGGCACTGAGCCATCAGGTAGCGAACCAGCAACTTCTGG<br>TACTGAACCATCAGGTACTAGCGAGCCATCTACTTCCGAACAGGTGCAGGTAGC<br>GGCGCATCCGAACCTACTTCCACTGAACCAGGTACTAGCGAGCCATCCACCTCTG<br>AACCAGGTGCAGGTAGCGAACCGGCAACTTCCGGCACTGAACCATCAGGTAGCG<br>AACCGGCTACCTCTGGTACTGAACCATCAGGTACTTCTACCGAACCATCCGAGCC<br>TGGTAGCGCAGGTACTTCTACCGAACCATCCGAGCCAGGCAGCGCAGGTAGCGG<br>TGCATCCGAGCCGACCTCTACTGAACCAGGTAGCGAACCAGCAACTTCTGGCACT<br>GAGCCATCAGGTAGCGAACCAGCTACCTCTGGTACTGAACCATCAGGTAGCGAA<br>CCGGCTACTTCCGGCACTGAACCATCAGGTAGCGAACCAGCAACCTCCGGTACTG<br>AACCATCAGGTACTTCCACTGAACCATCCGAACCGGGTAGCGCAGGTAGCGAAC<br>CGGCAACTTCCGGCACTGAACCATCAGGTAGCGGTGCATCTGAGCCGACCTCTAC<br>TGAACCAGGTACTTCTACTGAACCATCTGAGCCGGGCAGCGCAGGTAGCGAACC<br>TGCAACCTCCGGCACTGAGCCATCAGGTAGCGGCGCATCTGAACCAACCTCTACT<br>GAACCAGGTACTTCCACCGAACCATCTGAGCCAGGCAGCGCAGGTAGCGGCGCA<br>TCTGAACCAACCTCTACTGAACCAGGTAGCGAACCAGCAACTTCTGGTACTGAAC<br>CATCAGGTAGCGGCGCATCTGAGCCTACTTCCACTGAACCAGGTAGCGAACCGG<br>CAACTTCCGGCACTGAACCATCAGGTAGCGGTGCATCTGAGCCGACCTCTACTGA<br>ACCAGGTACTTCTACTGAACCATCTGAGCCGGGCAGCGCAGGTAGCGAACCGGC<br>AACTTCCGGCACTGAACCATCAGGTAGCGGTGCATCTGAGCCGACCTCTACTGAA<br>CCAGGTACTTCTACTGAACCATCTGAGCCGGGCAGCGCAGGTAGCGAACCAGCT<br>ACTTCTGGCACTGAACCATCAGGTACTTCTACTGAACCATCCGAACCAGGTAGCG<br>CAGGTAGCGAACCTGCTACCTCTGGTACTGAGCCATCAGGTACTTCTACTGAACC<br>ATCCGAGCCGGGTAGCGCAGGTACTTCCACTGAACCATCTGAACCTGGTAGCGC<br>AGGTACTTCCACTGAACCATCCGAACCAGGTAGCGCAGGTACTTCTACTGAACCA<br>TCCGAGCCGGGTAGCGCAGGTACTTCCACTGAACCATCTGAACCTGGTAGCGCA<br>GGTACTTCCACTGAACCATCCGAACCAGGTAGCGCAGGTACTAGCGAACCATCC<br>ACCTCCGAACCAGGCGCAGGTAGCGGTGCATCTGAACCGACTTCTACTGAACCA<br>GGTACTTCCACTGAACCATCTGAGCCAGGTAGCGCAGGTACTTCCACCGAACCAT<br>CCGAACCAGGTAGCGCAGGTACTTCCACCGAACCATCCGAACCTGGCAGCGCAG<br>GTAGCGAACCGGCAACCTCTGGTACTGAACCATCAGGTAGCGGTGCATCCGAGC<br>CGACCTCTACTGAACCAGGTAGCGAACCAGCAACTTCTGGCACTGAGCCATCAG<br>GTAGCGAACCAGCTACCTCTGGTACTGAACCATCAGGTAGCGAACCGGCAACCT<br>CTGGCACTGAGCCATCAGGTAGCGAACCAGCAACTTCTGGTACTGAACCATCAG<br>GTACTAGCGAGCCATCTACTTCCGAACCAGGTGCAGGTAGCGAACCTGCAACCTC<br>CGGCACTGAGCCATCAGGTAGCGGCGCATCTGAACCAACCTCTACTGAACCAGG<br>TACTTCCACCGAACCATCTGAGCCAGGCAGCGCAGGTAGCGAACCTGCAACCTC<br>CGGCACTGAGCCATCAGGTAGCGGCGCATCTGAACCAACCTCTACTGAACCAGG<br>TACTTCCACCGAACCATCTGAGCCAGGCAGCGCA |

TABLE 11-continued

DNA sequences of XTEN and precursor sequences

| XTEN Name | SEQ ID NO: | DNA Sequence |
|---|---|---|
| BD864 | 260 | GGTAGCGAAACTGCTACTTCCGGCTCTGAGACTGCAGGTACTAGTGAATCCGCAA<br>CTAGCGAATCTGGCGCAGGTAGCACTGCAGGCTCTGAGACTTCCACTGAAGCAG<br>GTACTAGCGAGTCCGCAACCAGCGAATCCGGCGCAGGTAGCGAAACTGCTACCT<br>CTGGCTCCGAGACTGCAGGTAGCGAAACTGCAACCTCTGGCTCTGAAACTGCAG<br>GTACTTCCACTGAAGCAAGTGAAGGCTCCGCATCAGGTACTTCCACCGAAGCAA<br>GCGAAGGCTCCGCATCAGGTACTAGTGAGTCCGCAACTAGCGAATCCGGTGCAG<br>GTAGCGAAACCGCTACCTCTGGTTCCGAAACTGCAGGTACTTCTACCGAGGCTAG<br>CGAAGGTTCTGCATCAGGTAGCACTGCTGGTTCCGAGACTTCTACTGAAGCAGGT<br>ACTAGCGAATCTGCTACTAGCGAATCCGGCGCAGGTACTAGCGAATCCGCTACC<br>AGCGAATCCGGCGCAGGTAGCGAAACTGCAACCTCTGGTTCCGAGACTGCAGGT<br>ACTAGCGAGTCCGCTACTAGCGAATCTGGCGCAGGTACTTCCACTGAAGCTAGTG<br>AAGGTTCTGCATCAGGTAGCGAAACTGCTACTTCTGGTTCCGAAACTGCAGGTAG<br>CGAAACCGCTACCTCTGGTTCCGAAACTGCAGGTACTTCTACCGAGGCTAGCGAA<br>GGTTCTGCATCAGGTAGCACTGCTGGTTCCGAGACTTCTACTGAAGCAGGTACTA<br>GCGAGTCCGCTACTAGCGAATCTGGCGCAGGTACTTCCACTGAAGCTAGTGAAG<br>GTTCTGCATCAGGTAGCGAAACTGCTACTTCTGGTTCCGAAACTGCAGGTAGCAC<br>TGCTGGCTCCGAGACTTCTACCGAAGCAGGTAGCACTGCAGGTTCCGAAACTTCC<br>ACTGAAGCAGGTAGCGAAACTGCTACCTCTGGCTCTGAGACTGCAGGTACTAGC<br>GAATCTGCTACTAGCGAATCCGGCGCAGGTACTAGCGAATCCGCTACCAGCGAA<br>TCCGGCGCAGGTAGCGAAACTGCAACCTCTGGTTCCGAGACTGCAGGTACTAGC<br>GAATCTGCTACTAGCGAATCCGGCGCAGGTACTAGCGAATCCGCTACCAGCGAA<br>TCCGGCGCAGGTAGCGAAACTGCAACCTCTGGTTCCGAGACTGCAGGTAGCGAA<br>ACCGCTACCTCTGGTTCCGAAACTGCAGGTACTTCTACCGAGGCTAGCGAAGGTT<br>CTGCATCAGGTAGCACTGCTGGTTCCGAGACTTCTACTGAAGCAGGTAGCGAAAC<br>TGCTACTTCCGGCTCTGAGACTGCAGGTACTAGTGAATCCGCAACTAGCGAATCT<br>GGCGCAGGTAGCACTGCAGGCTCTGAGACTTCCACTGAAGCAGGTAGCACTGCT<br>GGTTCCGAAACCTCTACCGAAGCAGGTAGCACTGCAGGTTCTGAAACCTCCACTG<br>AAGCAGGTACTTCCACTGAGGCTAGTGAAGGCTCTGCATCAGGTAGCACTGCTG<br>GTTCCGAAACCTCTACCGAAGCAGGTAGCACTGCAGGTTCTGAAACCTCCACTGA<br>AGCAGGTACTTCCACTGAGGCTAGTGAAGGCTCTGCATCAGGTAGCACTGCAGG<br>TTCTGAGACTTCCACCGAAGCAGGTAGCGAAACTGCTACTTCTGGTTCCGAAACT<br>GCAGGTACTTCCACTGAAGCTAGTGAAGGTTCCGCATCAGGTACTAGTGAGTCCG<br>CAACCAGCGAATCCGGCGCAGGTAGCGAAACCGCAACCTCCGGTTCTGAAACTG<br>CAGGTACTAGCGAATCCGCAACCAGCGAATCTGGCGCAGGTACTAGTGAGTCCG<br>CAACCAGCGAATCCGGCGCAGGTAGCGAAACCGCAACCTCCGGTTCTGAAACTG<br>CAGGTACTAGCGAATCCGCAACCAGCGAATCTGGCGCAGGTAGCGAAACTGCTA<br>CTTCCGGCTCTGAGACTGCAGGTACTTCCACCGAAGCAAGCGAAGGTTCCGCATC<br>AGGTACTTCCACCGAGGCTAGTGAAGGCTCTGCATCAGGTAGCACTGCTGGCTCC<br>GAGACTTCTACCGAAGCAGGTAGCACTGCAGGTTCCGAAACTTCCACTGAAGCA<br>GGTAGCGAAACTGCTACCTCTGGCTCTGAGACTGCAGGTACTAGCGAATCTGCTA<br>CTAGCGAATCCGGCGCAGGTACTAGCGAATCCGCTACCAGCGAATCCGGCGCAG<br>GTAGCGAAACTGCAACCTCTGGTTCCGAGACTGCAGGTAGCGAAACTGCTACTTC<br>CGGCTCCGAGACTGCAGGTAGCGAAACTGCTACTTCTGGCTCCGAAACTGCAGGT<br>ACTTCTACTGAGGCTAGTGAAGGTTCCGCATCAGGTACTAGCGAGTCCGCAACCA<br>GCGAATCCGGCGCAGGTAGCGAAACTGCTACCTCTGGCTCCGAGACTGCAGGTA<br>GCGAAACTGCAACCTCTGGCTCTGAAACTGCAGGTACTAGCGAATCTGCTACTAG<br>CGAATCCGGCGCAGGTACTAGCGAATCCGCTACCAGCGAATCCGGCGCAGGTAG<br>CGAAACTGCAACCTCTGGTTCCGAGACTGCA |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferace, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization can be performed using computer programs (Gustafsson, C., et al. (2004) Trends Biotechnol, 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in E. coli). In the case of E. coli, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene may comprise one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 261). In another embodiment, a sequencing island is the sequence

```
                                        (SEQ ID NO: 262)
5'-AGGTCCAGAACCAACGGGGCCGGCCCCAAGCGGAGGT-3'.
```

As an alternative, one can construct codon libraries where all members of the library encode the same amino acid sequence but where codon usage is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences can allow some variation in amino acid sequence. For instance one can randomize some codons such that a number of hydrophilic amino acids can occur in a particular position.

During the process of iterative multimerization one can screen the resulting library members for other characteristics like solubility or protease resistance in addition to a screen for high-level expression.

Figure 2:
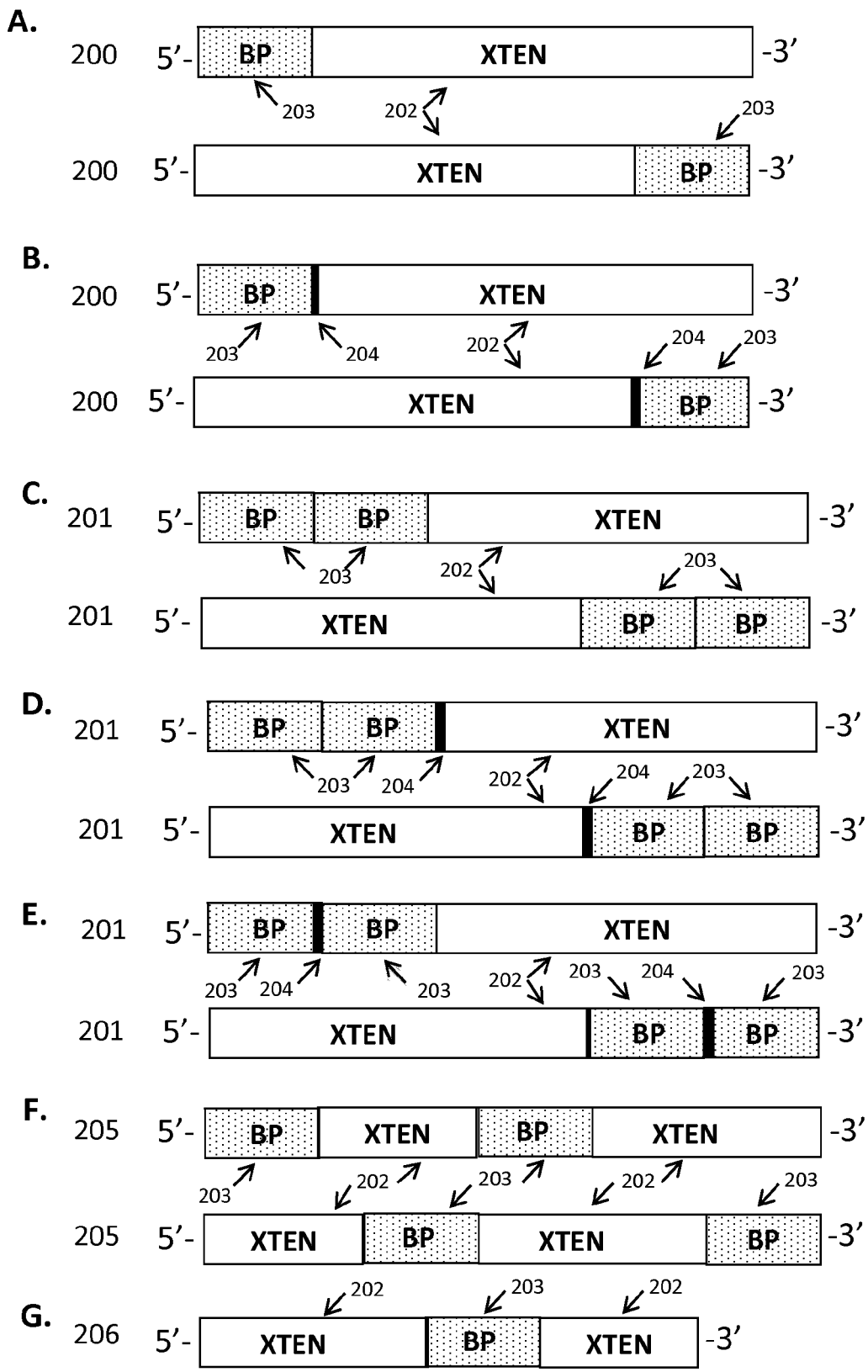
FIG. 2 is a schematic illustration of exemplary polynucleotide constructs (FIGS. 2A-G) of BPXTEN genes that encode the corresponding BPXTEN polypeptides of FIG. 1; all depicted in a 5' to 3' orientation. In these illustrative examples the genes encode BPXTEN fusion proteins with one BP and XTEN (100); or two BP, one spacer sequence and one XTEN (201); two BP and two XTEN (205); or one BP and two XTEN (206). In these depictions, the polynucleotides encode the following components: XTEN (202), BP (203), and spacer amino acids that can include a cleavage sequence (204), with all sequences linked in frame.

Once the gene that encodes the XTEN of desired length and properties is selected, it is genetically fused to the nucleotides encoding the N- and/or the C-terminus of the BP gene(s) by cloning it into the construct adjacent and in frame with the gene coding for BP or adjacent to a spacer sequence. The invention provides various permutations of the foregoing, depending on the BPXTEN to be encoded. For example, a gene encoding a BPXTEN fusion protein comprising two BP such as embodied by formula III or IV, as depicted above, the gene would have polynucleotides encoding two BP, at least a first XTEN, and optionally a second XTEN and/or spacer sequences. The step of cloning the BP genes into the XTEN construct can occur through a ligation or multimerization step. As shown in FIG. 2, the constructs encoding BPXTEN fusion proteins can be designed in different configurations of the components XTEN 202, BP 203, and spacer sequences 204. In one embodiment, as illustrated in FIG. 2A, the construct comprises polynucleotide sequences complementary to, or those that encode a monomeric polypeptide of components in the following order (5' to 3') BP 203 and XTEN 202, or the reverse order. In another embodiment, as illustrated in FIG. 2B, the construct comprises polynucleotide sequences complementary to, or those that encode a monomeric polypeptide of components in the following order (5' to 3') BP 203, spacer sequence 204, and XTEN 202, or the reverse order. In another embodiment, as illustrated in FIG. 2C, the construct 201 encodes a monomeric BPXTEN comprising polynucleotide sequences complementary to, or those that encode components in the following order (5' to 3'): two molecules of BP 203 and XTEN 202, or the reverse order. In another embodiment, as illustrated in FIG. 2D, the construct comprises polynucleotide sequences complementary to, or those that encode a monomeric polypeptide of components in the following order (5' to 3'): two molecules of BP 203, spacer sequence 204, and XTEN 202, or the reverse order. In another embodiment, as illustrated in FIG. 2E, the construct comprises polynucleotide sequences complementary to, or those that encode a monomeric polypeptide of components in the following order (5' to 3'): BP 203, spacer sequence 204, a second molecule of BP 203, and XTEN 202, or the reverse order. In another embodiment, as illustrated in FIG. 2F, the construct comprises polynucleotide sequences complementary to, or those that encode a monomeric polypeptide of components in the following order (5' to 3'): BP 203, XTEN 202, BP 203, and a second XTEN 202, or the reverse sequence. The spacer polynucleotides can optionally comprise sequences encoding cleavage sequences. As will be apparent to those of skill in the art, other permutations of the foregoing are possible.

The invention also encompasses polynucleotides comprising XTEN-encoding polynucleotide variants that have a high percentage of sequence identity to (a) a polynucleotide sequence from Table 11, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the BPXTEN sequences under stringent conditions, such as those described herein.

The resulting polynucleotides encoding the BPXTEN chimeric compositions can then be individually cloned into an expression vector. The nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage. Both expression and cloning vectors contain a nucleic acid sequence that enables the vector to replicate in one or more selected host cells. Such vector sequences are well known for a variety of bacteria, yeast, and viruses. Useful expression vectors that can be used include, for example, segments of chromosomal, non-chromosomal and synthetic DNA sequences. Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)]. Promoters for use in bacterial systems can also contain a Shine-Dalgarno (S.D.) sequence operably linked to the DNA encoding BPXTEN polypeptides.

For example, in a baculovirus expression system, both non-fusion transfer vectors, such as, but not limited to pVL941 (BamHI cloning site, available from Summers, et al., Virology 84:390-402 (1978)), pVL1393 (BamHI, Smal, Xbal, EcoRI, IVotl, Xmalll, BgIII and Pstl cloning sites; Invitrogen), pVL1392 (BgIII, Pstl, NotI, XmaIII, EcoRI, Xball, Smal and BamHI cloning site; Summers, et al., Virology 84:390-402 (1978) and Invitrogen) and pBlueBacIII (BamHI, BgIII, Pstl, Ncol and Hindi II cloning site, with blue/white recombinant screening, Invitrogen), and fusion transfer vectors such as, but not limited to, pAc7 00 (BamHI and Kpnl cloning sites, in which the BamHI recognition site begins with the initiation codon; Summers, et al., Virology 84:390-402 (1978)), pAc701 and pAc70-2 (same as pAc700, with different reading frames), pAc360 [BamHI cloning site 36 base pairs downstream of a polyhedrin initiation codon; Invitrogen (1995)) and pBlueBacHisA, B, C (three different reading frames with BamH I, BgI II, Pstl, Nco l and Hind III cloning site, an N-terminal peptide for ProBond purification and blue/white recombinant screening of plaques; Invitrogen (220) can be used.

Mammalian expression vectors can comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (Pstl, Sail, Sbal, Smal and EcoRI cloning sites, with the vector expressing both the cloned gene and DHFR; Randal J. Kaufman, 1991, Randal J. Kaufman, Current Protocols in Molecular Biology, 16, 12 (1991)). Alternatively a glutamine synthetase/methionine sulfoximine co-amplification vector, such as pEE14 (HindIII, Xball, Smal, Sbal, EcoRI and Sell cloning sites in which the vector expresses glutamine synthetase and the cloned gene; Celltech). A vector that directs episomal expression under the control of the Epstein Barr Virus (EBV) or nuclear antigen (EBNA) can be used such as pREP4 (BamHI r SfH, Xhol, NotI, Nhel, Hindi II, Nhel, PvuII and Kpnl cloning sites, constitutive RSV-LTR promoter, hygromycin selectable marker; Invitrogen), pCEP4 (BamHI, SfH, Xhol, NotI, Nhel, Hindl, Nhel, PvuII and Kpnl cloning sites, constitutive hCMV immediate early gene promoter, hygromycin selectable marker; Invitrogen), pMEP4 (Kpnl, Pvul, Nhel, Hindlll, NotI, Xhol, Sfil, BamHI cloning sites, inducible methallothionein H a gene promoter, hygromycin selectable marker, Invitrogen), pREP8 (BamHI, XhoI, NotI, Hindlll, Nhel and Kpnl cloning sites, RSV-LTR promoter, histidinol selectable marker; Invitrogen), pREP9 (Kpnl, Nhel, Hindlll, NotI, Xho l, Sfi l, BamH I cloning sites, RSV-LTR promoter, G418 selectable marker; Invitrogen), and pEBVHis (RSV-LTR promoter, hygromycin selectable marker, N-terminal peptide purifiable via ProBond resin and cleaved by enterokinase; Invitrogen).

Selectable mammalian expression vectors for use in the invention include, but are not limited to, pRc/CMV (Hind lll, BstXI, NotI, Sbal and Apal cloning sites, G418 selection, Invitrogen), pRc/RSV (Hind II, Spel, BstXI, NotI, XbaI cloning sites, G418 selection, Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11 (Smal cloning site, TK- and beta-gal selection), pMJ601 (Sal l, Sma l, A fII, Narl, BspMII, BamHI, Apal, Nhel, SacII, Kpnl and Hindlll cloning sites; TK- and -gal selection), pTKgptFlS (EcoRI, Pstl, SalII Accl, HindII, Sbal, BamHI and Hpa cloning sites, TK or XPRT selection) and the like.

Yeast expression systems that can also be used in the present invention include, but are not limited to, the non-fusion pYES2 vector (XJbal, Sphl, Shol, NotI, GstXI, EcoRI, BstXI, BamHI, Sad, Kpnl and Hindlll cloning sites, Invitrogen), the fusion pYESHisA, B, C (Xball, Sphl, Shol, NotI, BstXI, EcoRI, BamHI, Sad, Kpnl and Hindi II cloning sites, N-terminal peptide purified with ProBond resin and cleaved with enterokinase; Invitrogen), pRS vectors and the like.

In addition, the expression vector containing the chimeric BPXTEN fusion protein-encoding polynucleotide molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR) inhibitor, guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

In one embodiment, the polynucleotide encoding a BPXTEN fusion protein composition can be fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for *E. coli* expression. Signal peptides preferred for yeast expression are ppL-alpha, DEX4, invertase signal peptide, acid phosphatase signal peptide, CPY, or INU1. For insect cell expression the preferred signal sequences are sexta adipokinetic hormone precursor, CP1, CP2, CP3, CP4, TPA, PAP, or gp67. For mammalian expression the preferred signal sequences are IL2L, SV40, IgG kappa and IgG lambda.

In another embodiment, a leader sequence, potentially comprising a well-expressed, independent protein domain, can be fused to the N-terminus of the BPXTEN sequence, separated by a protease cleavage site. While any leader peptide sequence which does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 263), FLAG tag, hemaglutinin tag, and green fluorescent protein. The leader sequence can also be further improved by codon optimization, especially in the second codon position following the ATG start codon, by methods well described in the literature and hereinabove.

Various in vitro enzymatic methods for cleaving proteins at specific sites are known. Such methods include use of enterokinase (DDDK (SEQ ID NO: 264)), Factor Xa (IDGR (SEQ ID NO: 265)), thrombin (LVPRGS (SEQ ID NO: 266)), PreScission™ (LEVLFQGP (SEQ ID NO: 267)), TEV protease (EQLYFQG (SEQ ID NO: 268)), 3C protease (ETLFQGP (SEQ ID NO: 269)), Sortase A (LPETG), Granzyme B (D/X, N/X, M/N or S/X), inteins, SUMO, DAPase (TAGZyme™), Aeromonas aminopeptidase, Aminopeptidase M, and carboxypeptidases A and B. Additional methods are disclosed in Arnau, et al., Protein Expression and Purification 48: 1-13 (2006).

In other embodiments, an optimized polynucleotide sequence encoding at least about 20 to about 60 amino acids with XTEN characteristics can be included at the N-terminus of the XTEN sequence to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity to AE912 (SEQ ID NO: 217). In another embodiment of the foregoing, the optimized polynucleotide encodes an XTEN sequence with at least about 90% sequence identity to AM923 (SEQ ID NO: 218).

In another embodiment, the protease site of the leader sequence construct is chosen such that it is recognized by an in vivo protease. In this embodiment, the protein is purified from the expression system while retaining the leader by avoiding contact with an appropriate protease. The full-length construct is then injected into a patient. Upon injection, the construct comes into contact with the protease specific for the cleavage site and is cleaved by the protease. In the case where the uncleaved protein is substantially less active than the cleaved form, this method has the beneficial effect of allowing higher initial doses while avoiding toxicity, as the active form is generated slowly in vivo. Some non-limiting examples of in vivo proteases which are useful for this application include tissue kallikrein, plasma kallikrein, trypsin, pepsin, chymotrypsin, thrombin, and matrix metalloproteinases, or the proteases of Table 10.

In this manner, a chimeric DNA molecule coding for a monomeric BPXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for expression of the chimeric DNA molecule encoding of BPXTEN.

The present invention also provides a host cell for expressing the monomeric fusion protein compositions disclosed herein. Examples of suitable eukaryotic host cells include, but are not limited to mammalian cells, such as VERO cells, HELA cells such as ATCC No. CCL2, CHO cell lines, COS cells, WI38 cells, BHK cells, HepG2 cells, 3T3 cells, A549 cells, PC12 cells, K562 cells, 293 cells, Sf9 cells and CvI cells. Examples of suitable non-mammalian eukaryotic cells include eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CB S4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 [1988]); *Candida; Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., Biochem. Biophys. Res. Commun., 112:284-289 [1983]; Tilburn et al., Gene, 26:205-221 [1983]; Yelton et al., Proc. Natl. Acad. Sci. USA, 81: 1470-1474 [1984]) and *A. niger* (Kelly and Hynes, EMBO J., 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis,* and *Rhodotorula*. A list of specific species that are exemplary of this class of yeasts may be found in C. Anthony, The Biochemistry of Methylotrophs, 269 (1982).

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma;* and *Vibrio*. Non-limiting examples of specific strains include: *Archaeoglobus fulgidus; Bdellovibrio bacteriovorus; Borrelia burgdorferi; Chloroflexus aurantiacus; Enterococcus faecalis; Enterococcus faecium; Lactobacillus johnsonii; Lactobacillus plantarum; Lactococcus lactis; Listeria innocua; Listeria monocytogenes; Oceanobacillus iheyensis; Paracoccus zeaxanthinifaciens; Pseudomonas mevalonii; Staphylococcus aureus; Staphylococcus epidermidis; Staphylococcus haemolyticus; Streptococcus agalactiae; Streptomyces griseolosporeus; Streptococcus mutans; Streptococcus pneumoniae; Streptococcus pyogenes; Thermoplasma acidophilum; Thermoplasma volcanium; Vibrio cholerae; Vibrio parahaemolyticus;* and *Vibrio vulnificus*.

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. For compositions secreted by the host cells, supernatant from centrifugation is separated and retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include, but are not limited to leupeptin, pepstatin or aprotinin. The supernatant then may be precipitated in successively increasing concentrations of saturated ammonium sulfate.

Gene expression may be measured in a sample directly, for example, by conventional Southern blotting, Northern blotting to quantitate the transcription of mRNA ([Thomas, Proc. Natl. Acad. Sci. USA, 77:5201-5205 (1980)]), dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence BP polypeptide or against a synthetic peptide based on the DNA sequences provided herein or against exogenous sequence fused to BP and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

Expressed BPXTEN polypeptide product(s) may be purified via methods known in the art or by methods disclosed herein. Procedures such as gel filtration, affinity purification, salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Some expressed BPXTEN may require refolding during isolation and purification. Methods of purification are described in Robert K. Scopes, Protein Purification Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

VII). Pharmaceutical Compositions

The present invention provides pharmaceutical compositions comprising BPXTEN. In one embodiment, the pharmaceutical composition comprises the BPXTEN fusion protein and at least one pharmaceutically acceptable carrier. BPXTEN polypeptides of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions.

The pharmaceutical compositions can be administered orally, intranasally, parenterally or by inhalation therapy, and may take the form of tablets, lozenges, granules, capsules, pills, ampoules, suppositories or aerosol form. They may also take the form of suspensions, solutions and emulsions of the active ingredient in aqueous or nonaqueous diluents, syrups, granulates or powders. In addition, the pharmaceutical compositions can also contain other pharmaceutically active compounds or a plurality of compounds of the invention.

More particularly, the present pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In one embodiment, the pharmaceutical composition is administered subcutaneously. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

Extended release formulations useful in the present invention may be oral formulations comprising a matrix and a coating composition. Suitable matrix materials may include waxes (e.g., carnauba, bees wax, paraffin wax, ceresine, shellac wax, fatty acids, and fatty alcohols), oils, hardened oils or fats (e.g., hardened rapeseed oil, castor oil, beef tallow, palm oil, and soya bean oil), and polymers (e.g., hydroxypropyl cellulose, polyvinylpyrrolidone, hydroxypropyl methyl cellulose, and polyethylene glycol). Other suitable matrix tabletting materials are microcrystalline cellulose, powdered cellulose, hydroxypropyl cellulose, ethyl cellulose, with other carriers, and fillers. Tablets may also contain granulates, coated powders, or pellets. Tablets may also be multi-layered. Multi-layered tablets are especially preferred when the active ingredients have markedly different pharmacokinetic profiles. Optionally, the finished tablet may be coated or uncoated.

The coating composition may comprise an insoluble matrix polymer and/or a water soluble material. Water soluble materials can be polymers such as polyethylene glycol, hydroxypropyl cellulose, hydroxypropyl methyl cellulose, polyvinylpyrrolidone, polyvinyl alcohol, or monomeric materials such as sugars (e.g., lactose, sucrose, fructose, mannitol and the like), salts (e.g., sodium chloride, potassium chloride and the like), organic acids (e.g., fumaric acid, succinic acid, lactic acid, and tartaric acid), and mixtures thereof. Optionally, an enteric polymer may be incorporated into the coating composition. Suitable enteric polymers include hydroxypropyl methyl cellulose, acetate succinate, hydroxypropyl methyl cellulose, phthalate, polyvinyl acetate phthalate, cellulose acetate phthalate, cellulose acetate trimellitate, shellac, zein, and polymethacrylates containing carboxyl groups. The coating composition may be plasticised by adding suitable plasticisers such as, for example, diethyl phthalate, citrate esters, polyethylene glycol, glycerol, acetylated glycerides, acetylated citrate esters, dibutylsebacate, and castor oil. The coating composition may also include a filler, which can be an insoluble material such as silicon dioxide, titanium dioxide, talc, kaolin, alumina, starch, powdered cellulose, MCC, or polacrilin potassium. The coating composition may be applied as a solution or latex in organic solvents or aqueous solvents or mixtures thereof. Solvents such as water, lower alcohol, lower chlorinated hydrocarbons, ketones, or mixtures thereof may be used.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (nonpolar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126, 966; 6,056,973; 6,043,094, the contents of which are incorporated by reference in their entirety.

Liposomes may be comprised of any lipid or lipid combination known in the art. For example, the vesicle-forming lipids may be naturally-occurring or synthetic lipids, including phospholipids, such as phosphatidylcholine, phosphatidylethanolamine, phosphatidic acid, phosphatidylserine, phasphatidylglycerol, phosphatidylinositol, and sphingomyelin as disclosed in U.S. Pat. Nos. 6,056,973 and 5,874,104. The vesicle-forming lipids may also be glycolipids, cerebrosides, or cationic lipids, such as 1,2-dioleyloxy-3-(trimethylamino) propane (DOTAP); N-[1-(2,3,-ditetradecyloxy)propyl]-N,N-dimethyl-N-hydroxyethylammonium bromide (DMRIE); N-[1-(2,3,-dioleyloxy)propyl]-N,N-dimethyl-N-hydroxy ethylammonium bromide (DORIE); N-[1-(2,3-dioleyloxy)propyl]-N,N,N-trimethylammonium chloride (DOTMA); 3 [N—(N',N'-dimethylaminoethane) carbamoly] cholesterol (DC-Chol); or dimethyldioctadecylammonium (DDAB) also as disclosed in U.S. Pat. No. 6,056,973. Cholesterol may also be present in the proper range to impart stability to the vesicle as disclosed in U.S. Pat. Nos. 5,916,588 and 5,874,104.

Additional liposomal technologies are described in U.S. Pat. Nos. 6,759,057; 6,406,713; 6,352,716; 6,316,024; 6,294, 191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660, 848; and 5,756,115.

Osmotic pumps may be used as slow release agents in the form of tablets, pills, capsules or implantable devices. Osmotic pumps are well known in the art and readily available to one of ordinary skill in the art from companies experienced in providing osmotic pumps for extended release drug delivery. Examples are ALZA's DUROS™; ALZA's OROS™; Osmotica Pharmaceutical's Osmodex™ system; Shire Laboratories' EnSoTrol™ system; and Alzet™. Patents that describe osmotic pump technology are U.S. Pat. Nos. 6,890,918; 6,838,093; 6,814,979; 6,713,086; 6,534,090; 6,514,532; 6,361,796; 6,352,721; 6,294,201; 6,284,276; 6,110,498; 5,573,776; 4,200,0984; and 4,088,864, the contents of which are incorporated herein by reference. One skilled in the art, considering both the disclosure of this invention and the disclosures of these other patents could produce an osmotic pump for the extended release of the polypeptides of the present invention.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

VIII). Pharmaceutical Kits

In another aspect, the invention provides a kit to facilitate the use of the BPXTEN polypeptides. In one embodiment, the kit comprises, in at least a first container: (a) an amount of a BPXTEN fusion protein composition sufficient to treat a disease, condition or disorder upon administration to a subject in need thereof; and (b) an amount of a pharmaceutically acceptable carrier; together in a formulation ready for injection or for reconstitution with sterile water, buffer, or dextrose; together with a label identifying the BPXTEN drug and storage and handling conditions, and a sheet of the approved indications for the drug, instructions for the reconstitution and/or administration of the BPXTEN drug for the use for the prevention and/or treatment of a approved indication, appropriate dosage and safety information, and information identifying the lot and expiration of the drug. In another embodiment of the foregoing, the kit can comprise a second container that can carry a suitable diluent for the BPXTEN composition, which will provide the user with the appropriate concentration of BPXTEN to be delivered to the subject.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence $[X]_3$ where X is a 12mer peptide with the sequences: GESPGGSSGSES (SEQ ID NO: 270), GSEGSSGPGESS (SEQ ID NO: 271), GSSESGS-SEGGP (SEQ ID NO: 272), or GSGGEPSESGSS (SEQ ID NO: 273). The insert was obtained by annealing the following pairs of phosphorylated synthetic oligonucleotide pairs:

```
AD1for:
                                        (SEQ ID NO: 274)
AGGTGAATCTCCDGGTGGYTCYAGCGGTTCYGARTC
```

```
AD1rev:
                                 (SEQ ID NO: 275)
ACCTGAYTCRGAACCGCTRGARCCACCHGGAGATTC AD2for:
                                 (SEQ ID NO: 276)
AGGTAGCGAAGGTTCTTCYGGTCCDGGYGARTCYTC AD2rev:
                                 (SEQ ID NO: 277)
ACCTGARGAYTCRCCHGGACCRGAAGAACCTTCGCT AD3for:
                                 (SEQ ID NO: 278)
AGGTTCYTCYGAAAGCGGTTCTTCYGARGGYGGTCC AD3rev:
                                 (SEQ ID NO: 279)
ACCTGGACCRCCYTCRGAAGAACCGCTTTCRGARGA AD4for:
                                 (SEQ ID NO: 280)
AGGTTCYGGTGGYGAACCDTCYGARTCTGGTAGCTC
```

We also annealed the phosphorylated oligonucleotide 3 KpnIstopperFor: AGGTTCGTCTTCACTCGAGGGTAC (SEQ ID NO: 281) and the non-phosphorylated oligonucleotide pr_3 KpnIstopperRev: CCTCGAGTGAAGACGA (SEQ ID NO: 282). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs and the SEQ ID NOS for these segments are listed in Table 12.

TABLE 12

DNA and Amino Acid Sequences for 36-mer motifs

| File name | SEQ ID NO: | Amino acid sequence | SEQ ID NO: | Nucleotide sequence |
|---|---|---|---|---|
| LCW0401_001_GFP-N_A01.ab1 | 283 | GSGGEPSESGSSGE SPGGSSGSESGESP GGSSGSES | 321 | GGTTCTGGTGGCGAACCGTCCGAGTCTG GTAGCTCAGGTGAATCTCCGGGTGGCTC TAGCGGTTCCGAGTCAGGTGAATCTCCT GGTGGTTCCAGCGGTTCCGAGTCA |
| LCW0401_002_GFP-N_B01.ab1 | 284 | GSEGSSGPGESSGE SPGGSSGSESGSSE SGSSEGGP | 322 | GGTAGCGAAGGTTCTTCTGGTCCTGGCG AGTCTTCAGGTGAATCTCCTGGTGGTTCC AGCGGTTCTGAATCAGGTTCCTCCGAAA GCGGTTCTTCCGAGGGCGGTCCA |
| LCW0401_003_GFP-N_C01.ab1 | 285 | GSSESGSSEGGPGS SESGSSEGGPGESP GGSSGSES | 323 | GGTTCCTCTGAAAGCGGTTCTTCCGAAG GTGGTCCAGGTTCCTCTGAAAGCGGTTCT TCTGAGGGTGGTCCAGGTGAATCTCCGG GTGGCTCCAGCGGTTCCGAGTCA |
| LCW0401_004_GFP-N_D01.ab1 | 286 | GSGGEPSESGSSGS SESGSSEGGPGSG GEPSESGSS | 324 | GGTTCCGGTGGCGAACCGTCTGAATCTG GTAGCTCAGGTTCTTCTGAAAGCGGTTCT TCCGAGGGTGGTCCAGGTTCTGGTGGTG AACCTTCCGAGTCTGGTAGCTCA |
| LCW0401_007_GFP-N_F01.ab1 | 287 | GSSESGSSEGGPGS EGSSGPGESSGSEG SSGPGESS | 325 | GGTTCTTCCGAAAGCGGTTCTTCTGAGGG TGGTCCAGGTAGCGAAGGTTCTTCCGGT CCAGGTGAGTCTTCAGGTAGCGAAGGTT CTTCTGGTCCTGGTGAATCTTCA |
| LCW0401_008_GFP-N_G01.ab1 | 288 | GSSESGSSEGGPGE SPGGSSGSESGSEG SSGPGESS | 326 | GGTTCCTCTGAAAGCGGTTCTTCCGAGG GTGGTCCAGGTGAATCTCCAGGTGGTTC CAGCGGTTCTGAGTCAGGTAGCGAAGGT TCTTCTGGTCCAGGTGAATCCTCA |
| LCW0401_012_GFP-N_H01.ab1 | 289 | GSGGEPSESGSSGS GGEPSESGSSGSEG SSGPGESS | 327 | GGTTCTGGTGGTGAACCGTCTGAGTCTG GTAGCTCAGGTTCCGGTGGCGAACCATC CGAATCTGGTAGCTCAGGTAGCGAAGGT TCTTCCGGTCCAGGTGAGTCTTCA |
| LCW0401_015_GFP-N_A02.ab1 | 290 | GSSESGSSEGGPGS EGSSGPGESSGESP GGSSGSES | 328 | GGTTCTTCCGAAAGCGGTTCTTCCGAAG GCGGTCCAGGTAGCGAAGGTTCTTCTGG TCCAGGCGAATCTTCAGGTGAATCTCCTG GTGGCTCCAGCGGTTCTGAGTCA |
| LCW0401_016_GFP-N_B02.ab1 | 291 | GSSESGSSEGGPGS SESGSSEGGPGSSE SGSSEGGP | 329 | GGTTCCTCCGAAAGCGGTTCTTCTGAGG GCGGTCCAGGTTCCTCCGAAAGCGGTTC TTCCGAGGGCGGTCCAGGTTCTTCTGAA AGCGGTTCTTCCGAGGGCGGTCCA |

TABLE 12-continued

DNA and Amino Acid Sequences for 36-mer motifs

| File name | SEQ ID NO: | Amino acid sequence | SEQ ID NO: | Nucleotide sequence |
|---|---|---|---|---|
| LCW0401_020_GFP-N_E02.ab1 | 292 | GSGGEPSESGSSGS EGSSGPGESSGSSE SGSSEGGP | 330 | GGTTCCGGTGGCGAACCGTCCGAATCTG GTAGCTCAGGTAGCGAAGGTTCTTCTGG TCCAGGCGAATCTTCAGGTTCCTCTGAAA GCGGTTCTTCTGAGGGCGGTCCA |
| LCW0401_022_GFP-N_F02.ab1 | 293 | GSGGEPSESGSSGS SESGSSEGGPGSG GEPSESGSS | 331 | GGTTCTGGTGGTGAACCGTCCGAATCTG GTAGCTCAGGTTCTTCCGAAAGCGGTTCT TCTGAAGGTGGTCCAGGTTCCGGTGGCG AACCTTCTGAATCTGGTAGCTCA |
| LCW0401_024_GFP-N_G02.ab1 | 294 | GSGGEPSESGSSGS SESGSSEGGPGESP GGSSGSES | 332 | GGTTCTGGTGGCGAACCGTCCGAATCTG GTAGCTCAGGTTCCTCCGAAAGCGGTTCT TCTGAAGGTGGTCCAGGTGAATCTCCAG GTGGTTCTAGCGGTTCTGAATCA |
| LCW0401_026_GFP-N_H02.ab1 | 295 | GSGGEPSESGSSGE SPGGSSGSESGSEG SSGPGESS | 333 | GGTTCTGGTGGCGAACCGTCTGAGTCTG GTAGCTCAGGTGAATCTCCTGGTGGCTCC AGCGGTTCTGAATCAGGTAGCGAAGGTT CTTCTGGTCCTGGTGAATCTTCA |
| LCW0401_027_GFP-N_A03.ab1 | 296 | GSGGEPSESGSSGE SPGGSSGSESGSG GEPSESGSS | 334 | GGTTCCGGTGGCGAACCTTCCGAATCTG GTAGCTCAGGTGAATCTCCGGGTGGTTCT AGCGGTTCTGAGTCAGGTTCTGGTGGTG AACCTTCCGAGTCTGGTAGCTCA |
| LCW0401_028_GFP-N_B03.ab1 | 297 | GSSESGSSEGGPGS SESGSSEGGPGSSE SGSSEGGP | 335 | GGTTCCTCTGAAAGCGGTTCTTCTGAGGG CGGTCCAGGTTCTTCCGAAAGCGGTTCTT CCGAGGGCGGTCCAGGTTCTTCCGAAAG CGGTTCTTCTGAAGGCGGTCCA |
| LCW0401_030_GFP-N_C03.ab1 | 298 | GESPGGSSGSESGS EGSSGPGESSGSEG SSGPGESS | 336 | GGTGAATCTCCGGGTGGCTCCAGCGGTT CTGAGTCAGGTAGCGAAGGTTCTTCCGG TCCGGGTGAGTCCTCAGGTAGCGAAGGT TCTTCCGGTCCTGGTGAGTCTTCA |
| LCW0401_031_GFP-N_D03.ab1 | 299 | GSGGEPSESGSSGS GGEPSESGSSGSSE SGSSEGGP | 337 | GGTTCTGGTGGCGAACCTTCCGAATCTG GTAGCTCAGGTTCCGGTGGTGAACCTTCT GAATCTGGTAGCTCAGGTTCTTCTGAAA GCGGTTCTTCCGAGGGCGGTCCA |
| LCW0401_033_GFP-N_E03.ab1 | 300 | GSGGEPSESGSSGS GGEPSESGSSGSG GEPSESGSS | 338 | GGTTCCGGTGGTGAACCTTCTGAATCTGG TAGCTCAGGTTCCGGTGGCGAACCATCC GAGTCTGGTAGCTCAGGTTCCGGTGGTG AACCATCCGAGTCTGGTAGCTCA |
| LCW0401_037_GFP-N_F03.ab1 | 301 | GSGGEPSESGSSGS SESGSSEGGPGSEG SSGPGESS | 339 | GGTTCCGGTGGCGAACCTTCTGAATCTG GTAGCTCAGGTTCCTCCGAAAGCGGTTCT TCTGAGGGCGGTCCAGGTAGCGAAGGTT CTTCTGGTCCGGGCGAGTCTTCA |
| LCW0401_038_GFP-N_G03.ab1 | 302 | GSGGEPSESGSSGS EGSSGPGESSGSG GEPSESGSS | 340 | GGTTCCGGTGGTGAACCGTCCGAGTCTG GTAGCTCAGGTAGCGAAGGTTCTTCTGG TCCGGGTGAGTCTTCAGGTTCTGGTGGCG AACCGTCCGAATCTGGTAGCTCA |
| LCW0401_039_GFP-N_H03.ab1 | 303 | GSGGEPSESGSSGE SPGGSSGSESGSG GEPSESGSS | 341 | GGTTCTGGTGGCGAACCGTCCGAATCTG GTAGCTCAGGTGAATCTCCTGGTGGTTCC AGCGGTTCCGAGTCAGGTTCTGGTGGCG AACCTTCCGAATCTGGTAGCTCA |
| LCW0401_040_GFP-N_A04.ab1 | 304 | GSSESGSSEGGPGS GGEPSESGSSGSSE SGSSEGGP | 342 | GGTTCTTCCGAAAGCGGTTCTTCCGAGG GCGGTCCAGGTTCCGGTGGTGAACCATCC TGAATCTGGTAGCTCAGGTTCTTCTGAAA GCGGTTCTTCTGAAGGTGGTCCA |
| LCW0401_042_GFP-N_C04.ab1 | 305 | GSEGSSGPGESSGE SPGGSSGSESGSEG SSGPGESS | 343 | GGTAGCGAAGGTTCTTCCGGTCCTGGTG AGTCTTCAGGTGAATCTCCAGGTGGCTCT AGCGGTTCCGAGTCAGGTAGCGAAGGTT CTTCTGGTCCTGGCGAGTCCTCA |
| LCW0401_046_GFP-N_D04.ab1 | 306 | GSSESGSSEGGPGS SESGSSEGGPGSSE SGSSEGGP | 344 | GGTTCCTCTGAAAGCGGTTCTTCCGAAG GCGGTCCAGGTTCTTCCGAAAGCGGTTCT TCTGAGGGCGGTCCAGGTTCCTCCGAAA GCGGTTCTTCTGAGGGTGGTCCA |

139
140

TABLE 12-continued

DNA and Amino Acid Sequences for 36-mer motifs

| File name | SEQ ID NO: | Amino acid sequence | SEQ ID NO: | Nucleotide sequence |
|---|---|---|---|---|
| LCW0401_047_GFP-N_E04.ab1 | 307 | GSGGEPSESGSSGESPGGSSGSESGESPGGSSGSES | 345 | GGTTCTGGTGGCGAACCTTCCGAGTCTGGTAGCTCAGGTGAATCTCCGGGTGGTTCTAGCGGTTCCGAGTCAGGTGAATCTCCGGGTGGTTCCAGCGGTTCTGAGTCA |
| LCW0401_051_GFP-N_F04.ab1 | 308 | GSGGEPSESGSSGSEGSSGPGESSGESPGGSSGSES | 346 | GGTTCTGGTGGCGAACCATCTGAGTCTGGTAGCTCAGGTAGCGAAGGTTCTTCCGGTCCAGGCGAGTCTTCAGGTGAATCTCCTGGTGGCTCCAGCGGTTCTGAGTCA |
| LCW0401_053_GFP-N_H04.ab1 | 309 | GESPGGSSGSESGESPGGSSGSESGESPGGSSGSES | 347 | GGTGAATCTCCTGGTGGTTCCAGCGGTTCCGAGTCAGGTGAATCTCCAGGTGGCTCTAGCGGTTCCGAGTCAGGTGAATCTCCTGGTGGTTCTAGCGGTTCTGAATCA |
| LCW0401_054_GFP-N_A05.ab1 | 310 | GSEGSSGPGESSGSEGSSGPGESSGSGGEPSESGSS | 348 | GGTAGCGAAGGTTCTTCCGGTCCAGGTGAATCTTCAGGTAGCGAAGGTTCTTCTGGTCCTGGTGAATCCTCAGGTTCCGGTGGCGAACCATCTGAATCTGGTAGCTCA |
| LCW0401_059_GFP-N_D05.ab1 | 311 | GSGGEPSESGSSGSEGSSGPGESSGESPGGSSGSES | 349 | GGTTCTGGTGGCGAACCATCCGAATCTGGTAGCTCAGGTAGCGAAGGTTCTTCTGGTCCTGGCGAATCTTCAGGTGAATCTCCAGGTGGCTCTAGCGGTTCCGAATCA |
| LCW0401_060_GFP-N_E05.ab1 | 312 | GSGGEPSESGSSGSSESGSSEGGPGSGGEPSESGSS | 350 | GGTTCCGGTGGTGAACCGTCCGAATCTGGTAGCTCAGGTTCCTCTGAAAGCGGTTCTTCCGAGGGTGGTCCAGGTTCCGGTGGTGAACCTTCTGAGTCTGGTAGCTCA |
| LCW0401_061_GFP-N_F05.ab1 | 313 | GSSESGSSEGGPGSGGEPSESGSSGSEGSSGPGESS | 351 | GGTTCCTCTGAAAGCGGTTCTTCTGAGGGCGGTCCAGGTTCTGGTGGCGAACCATCTGAATCTGGTAGCTCAGGTAGCGAAGGTTCTTCCGGTCCGGGTGAATCTTCA |
| LCW0401_063_GFP-N_H05.ab1 | 314 | GSGGEPSESGSSGSEGSSGPGESSGSEGSSGPGESS | 352 | GGTTCTGGTGGTGAACCGTCCGAATCTGGTAGCTCAGGTAGCGAAGGTTCTTCTGGTCCTGGCGAGTCTTCAGGTAGCGAAGGTCTTCTGGTCCTGGTGAATCTTCA |
| LCW0401_066_GFP-N_B06.ab1 | 315 | GSGGEPSESGSSGSSESGSSEGGPGSGGEPSESGSS | 353 | GGTTCTGGTGGCGAACCATCCGAGTCTGGTAGCTCAGGTTCTTCCGAAAGCGGTTCTTCCGAAGGCGGTCCAGGTTCTGGTGGTGAACCGTCCGAATCTGGTAGCTCA |
| LCW0401_067_GFP-N_C06.ab1 | 316 | GSGGEPSESGSSGESPGGSSGSESGESPGGSSGSES | 354 | GGTTCCGGTGGCGAACCTTCCGAATCTGGTAGCTCAGGTGAATCTCCGGGTTCTAGCGGTTCCGAATCAGGTGAATCTCCAGGTGGTTCTAGCGGTTCCGAATCA |
| LCW0401_069_GFP-N_D06.ab1 | 317 | GSGGEPSESGSSGSGGEPSESGSSGESPGGSSGSES | 355 | GGTTCCGGTGGTGAACCATCTGAGTCTGGTAGCTCAGGTTCCGGTGGCGAACCGTCCGAGTCTGGTAGCTCAGGTGAATCTCCGGGTGGTTCCAGCGGTTCCGAATCA |
| LCW0401_070_GFP-N_E06.ab1 | 318 | GSEGSSGPGESSGSSESGSSEGGPGSEGSSGPGESS | 356 | GGTAGCGAAGGTTCTTCTGGTCCGGGCGAATCCTCAGGTTCCTCCGAAAGCGGTTCTTCCGAAGGTGGTCCAGGTAGCGAAGGTTCTTCCGGTCCTGGTGAATCTTCA |
| LCW0401_078_GFP-N_F06.ab1 | 319 | GSSESGSSEGGPGESPGGSSGSESGESPGGSSGSES | 357 | GGTTCCTCTGAAAGCGGTTCTTCTGAAGGCGGTCCAGGTGAATCTCCGGGTGGCTCCAGCGGTTCTGAATCAGGTGAATCTCCTGGTGGCTCCAGCGGTTCCGAGTCA |
| LCW0401_079_GFP-N_G06.ab1 | 320 | GSEGSSGPGESSGSEGSSGPGESSGSGGEPSESGSS | 358 | GGTAGCGAAGGTTCTTCTGGTCCAGGCGAGTCTTCAGGTAGCGAAGGTTCTTCCGGTCCTGGCGAGTCTTCAGGTTCCGGTGGCGAACCGTCCGAATCTGGTAGCTCA |

Example 2

Construction of XTEN_AE36 Segments

A codon library encoding XTEN sequences of 36 amino acid length was constructed. The XTEN sequence was designated XTEN_AE36. Its segments have the amino acid sequence [α]₃ where X is a 12mer peptide with the sequence: GSPAGSPTSTEE (SEQ ID NO: 359), GSEPATSGSE TP (SEQ ID NO: 360), GTSESA TPESGP (SEQ ID NO: 361), or GTSTEPSEGSAP (SEQ ID NO: 362). The insert was obtained by annealing the following pairs of phosphorylated synthetic oligonucleotide pairs:

```
AE1for:
                                      (SEQ ID NO: 363)
AGGTAGCCCDGCWGGYTCTCCDACYTCYACYGARGA AE1rev:
                                      (SEQ ID NO: 364)
ACCTTCYTCRGTRGARGTHGGAGARCCWGCHGGGCT AE2for:
                                      (SEQ ID NO: 365)
AGGTAGCGAACCKGCWACYTCYGGYTCTGARACYCC AE2rev:
                                      (SEQ ID NO: 366)
ACCTGGRGTYTCAGARCCRGARGTWGCMGGTTCGCT AE3for:
                                      (SEQ ID NO: 367)
AGGTACYTCTGAAAGCGCWACYCCKGARTCYGGYCC AE3rev:
                                      (SEQ ID NO: 368)
ACCTGGRCCRGAYTCMGGRGTWGCGCTTTCAGARGT AE4for:
                                      (SEQ ID NO: 369)
AGGTACYTCTACYGAACCKTCYGARGGYAGCGCWCC AE4rev:
                                      (SEQ ID NO: 370)
ACCTGGWGCGCTRCCYTCRGAMGGTTCRGTAGARGT
```

We also annealed the phosphorylated oligonucleotide 3 KpnIstopperFor: AGGTTCGTCTTCACTCGAGGGTAC (SEQ ID NO: 371) and the non-phosphorylated oligonucleotide pr_3 KpnIstopperRev: CCTCGAGTGAAGACGA (SEQ ID NO: 372). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs and the SEQ ID NOS for these segments are listed in Table 13.

TABLE 13

DNA and Amino Acid Sequences for 36-mer motifs

| File name | SEQ ID NO: | Amino acid sequence | SEQ ID NO: | Nucleotide sequence |
| --- | --- | --- | --- | --- |
| LCW0402_002_GFP-N_A07.ab1 | 373 | GSPAGSPTSTEE GTSESATPESGP GTSTEPSEGSAP | 410 | GGTAGCCCGGCAGGCTCTCCGACCTCTACT GAGGAAGGTACTTCTGAAAGCGCAACCCCG GAGTCCGGCCCAGGTACCTCTACCGAACCG TCTGAGGGCAGCGCACCA |
| LCW0402_003_GFP-N_B07.ab1 | 374 | GTSTEPSEGSAP GTSTEPSEGSAP GTSTEPSEGSAP | 411 | GGTACTTCTACCGAACCGTCCGAAGGCAGC GCTCCAGGTACCTCTACTGAACCTTCCGAG GGCAGCGCTCCAGGTACCTCTACCGAACCT TCTGAAGGTAGCGCACCA |
| LCW0402_004_GFP-N_C07.ab1 | 375 | GTSTEPSEGSAP GTSESATPESGP GTSESATPESGP | 412 | GGTACCTCTACCGAACCGTCTGAAGGTAGC GCACCAGGTACCTCTGAAAGCGCAACTCCT GAGTCCGGTCCAGGTACTTCTGAAAGCGCA ACCCCGGAGTCTGGCCCA |
| LCW0402_005_GFP-N_D07.ab1 | 376 | GTSTEPSEGSAP GTSESATPESGP GTSESATPESGP | 413 | GGTACTTCTACTGAACCGTCTGAAGGTAGC GCACCAGGTACTTCTGAAAGCGCAACCCCG GAATCCGGCCCAGGTACCTCTGAAAGCGCA ACCCCGGAGTCCGGCCCA |
| LCW0402_006_GFP-N_E07.ab1 | 377 | GSEPATSGSETP GTSESATPESGP GSPAGSPTSTEE | 414 | GGTAGCGAACCGGCAACCTCCGGCTCTGAA ACCCCAGGTACCTCTGAAAGCGCTACTCCT GAATCCGGCCCAGGTAGCCCGGCAGGTTCT CCGACTTCCACTGAGGAA |
| LCW0402_008_GFP-N_F07.ab1 | 378 | GTSESATPESGP GSEPATSGSETP GTSTEPSEGSAP | 415 | GGTACTTCTGAAAGCGCAACCCCTGAATCC GGTCCAGGTAGCGAACCGGCTACTTCTGGC TCTGAGACTCCAGGTACTTCTACCGAACCGT CCGAAGGTAGCGCACCA |

TABLE 13-continued

DNA and Amino Acid Sequences for 36-mer motifs

| File name | SEQ ID NO: | Amino acid sequence | SEQ ID NO: | Nucleotide sequence |
|---|---|---|---|---|
| LCW0402_009_GFP-N_G07.ab1 | 379 | GSPAGSPTSTEE GSPAGSPTSTEE GSEPATSGSETP | 416 | GGTAGCCCGGCTGGCTCTCCAACCTCCACT GAGGAAGGTAGCCCGGCTGGCTCTCCAACC TCCACTGAAGAAGGTAGCGAACCGGCTACC TCCGGCTCTGAAACTCCA |
| LCW0402_011_GFP-N_A08.ab1 | 380 | GSPAGSPTSTEE GTSESATPESGP GTSTEPSEGSAP | 417 | GGTAGCCCGGCTGGCTCTCCTACCTCTACTG AGGAAGGTACTTCTGAAAGCGCTACTCCTG AGTCTGGTCCAGGTACCTCTACTGAACCGTC CGAAGGTAGCGCTCCA |
| LCW0402_012_GFP-N_B08.ab1 | 381 | GSPAGSPTSTEE GSPAGSPTSTEE GTSTEPSEGSAP | 418 | GGTAGCCCTGCTGGCTCTCCGACTTCTACTG AGGAAGGTAGCCCGGCTGGTTCTCCGACTT CTACTGAGGAAGGTACTTCTACCGAACCTT CCGAAGGTAGCGCTCCA |
| LCW0402_013_GFP-N_C08.ab1 | 382 | GTSESATPESGP GTSTEPSEGSAP GTSTEPSEGSAP | 419 | GGTACTTCTGAAAGCGCTACTCCGGAGTCC GGTCCAGGTACCTCTACCGAACCGTCCGAA GGCAGCGCTCCAGGTACTTCTACTGAACCTT CTGAGGGTAGCGCTCCA |
| LCW0402_014_GFP-N_D08.ab1 | 383 | GTSTEPSEGSAP GSPAGSPTSTEE GTSTEPSEGSAP | 420 | GGTACCTCTACCGAACCTTCCGAAGGTAGC GCTCCAGGTAGCCCGGCAGGTTCTCCTACTT CCACTGAGGAAGGTACTTCTACCGAACCTT CTGAGGGTAGCGCACCA |
| LCW0402_015_GFP-N_E08.ab1 | 384 | GSEPATSGSETP GSPAGSPTSTEE GTSESATPESGP | 421 | GGTAGCGAACCGGCTACTTCCGGCTCTGAG ACTCCAGGTAGCCCTGCTGGCTCTCCGACCT CTACCGAAGAAGGTACTCTGAAAGCGCTA CCCCTGAGTCTGGCCCA |
| LCW0402_016_GFP-N_F08.ab1 | 385 | GTSTEPSEGSAP GTSESATPESGP GTSESATPESGP | 422 | GGTACTTCTACCGAACCTTCCGAGGGCAGC GCACCAGGTACTTCTGAAAGCGCTACCCCT GAGTCCGGCCCAGGTACTTCTGAAAGCGCT ACTCCTGAATCCGGTCCA |
| LCW0402_020_GFP-N_G08.ab1 | 386 | GTSTEPSEGSAP GSEPATSGSETP GSPAGSPTSTEE | 423 | GGTACTTCTACTGAACCGTCTGAAGGCAGC GCACCAGGTAGCGAACCGGCTACTTCCGGT TCTGAAACCCCAGGTAGCCCAGCAGGTTCT CCAACTTCTACTGAAGAA |
| LCW0402_023_GFP-N_A09.ab1 | 387 | GSPAGSPTSTEE GTSESATPESGP GSEPATSGSETP | 424 | GGTAGCCCTGCTGGCTCTCCAACCTCCACCG AAGAAGGTACCTCTGAAAGCGCAACCCCTG AATCCGGCCCAGGTAGCGAACCGGCAACCT CCGGTTCTGAAACCCCA |
| LCW0402_024_GFP-N_B09.ab1 | 388 | GTSESATPESGP GSPAGSPTSTEE GSPAGSPTSTEE | 425 | GGTACTTCTGAAAGCGCTACTCCTGAGTCC GGCCCAGGTAGCCCGGCTGGCTCTCCGACT TCCACCGAGGAAGGTAGCCCGGCTGGCTCT CCAACTTCTACTGAAGAA |
| LCW0402_025_GFP-N_C09.ab1 | 389 | GTSTEPSEGSAP GTSESATPESGP GTSTEPSEGSAP | 426 | GGTACCTCTACTGAACCTTCTGAGGGCAGC GCTCCAGGTACTTCTGAAAGCGCTACCCCG GAGTCCGGTCCAGGTACTTCTACTGAACCG TCCGAAGGTAGCGCACCA |
| LCW0402_026_GFP-N_D09.ab1 | 390 | GSPAGSPTSTEE GTSTEPSEGSAP GSEPATSGSETP | 427 | GGTAGCCCGGCAGGCTCTCCGACTTCCACC GAGGAAGGTACCTCTACTGAACCTTCTGAG GGTAGCGCTCCAGGTAGCGAACCGGCAACC TCTGGCTCTGAAACCCCA |
| LCW0402_027_GFP-N_E09.ab1 | 391 | GSPAGSPTSTEE GTSTEPSEGSAP GTSTEPSEGSAP | 428 | GGTAGCCCAGCAGGCTCTCCGACTTCCACT GAGGAAGGTACTTCTACTGAACCTTCCGAA GGCAGCGCACCAGGTACCTCTACTGAACCT TCTGAGGGCAGCGCTCCA |
| LCW0402_032_GFP-N_H09.ab1 | 392 | GSEPATSGSETP GTSESATPESGP GSPAGSPTSTEE | 429 | GGTAGCGAACCTGCTACCTCCGGTTCTGAA ACCCCAGGTACCTCTGAAAGCGCAACTCCG GAGTCTGGTCCAGGTAGCCCTGCAGGTTCT CCTACCTCCACTGAGGAA |
| LCW0402_034_GFP-N_A10.ab1 | 393 | GTSESATPESGP GTSTEPSEGSAP GTSTEPSEGSAP | 430 | GGTACCTCTGAAAGCGCTACTCCGGAGTCT GGCCCAGGTACCTCTACTGAACCGTCTGAG GGTAGCGCTCCAGGTACTTCTACTGAACCG TCCGAAGGTAGCGCACCA |

TABLE 13-continued

DNA and Amino Acid Sequences for 36-mer motifs

| File name | SEQ ID NO: | Amino acid sequence | SEQ ID NO: | Nucleotide sequence |
|---|---|---|---|---|
| LCW0402_036_GFP-N_C10.ab1 | 394 | GSPAGSPTSTEE GTSTEPSEGSAP GTSTEPSEGSAP | 431 | GGTAGCCCGGCTGGTTCTCCGACTTCCACCG AGGAAGGTACCTCTACTGAACCTTCTGAGG GTAGCGCTCCAGGTACCTCTACTGAACCTTC CGAAGGCAGCGCTCCA |
| LCW0402_039_GFP-N_E10.ab1 | 395 | GTSTEPSEGSAP GTSTEPSEGSAP GTSTEPSEGSAP | 432 | GGTACTTCTACCGAACCGTCCGAGGGCAGC GCTCCAGGTACTTCTACTGAACCTTCTGAAG GCAGCGCTCCAGGTACTTCTACTGAACCTTC CGAAGGTAGCGCACCA |
| LCW0402_040_GFP-N_F10.ab1 | 396 | GSEPATSGSETP GTSESATPESGP GTSTEPSEGSAP | 433 | GGTAGCGAACCTGCAACCTCTGGCTCTGAA ACCCCAGGTACCTCTGAAAGCGCTACTCCT GAATCTGGCCCAGGTACTTCTACTGAACCG TCCGAGGGCAGCGCACCA |
| LCW0402_041_GFP-N_G10.ab1 | 397 | GTSTEPSEGSAP GSPAGSPTSTEE GTSTEPSEGSAP | 434 | GGTACTTCTACCGAACCGTCCGAGGGTAGC GCACCAGGTAGCCCAGCAGGTTCTCCTACC TCCACCGAGGAAGGTACTTCTACCGAACCG TCCGAGGGTAGCGCACCA |
| LCW0402_050_GFP-N_A11.ab1 | 398 | GSEPATSGSETP GTSESATPESGP GSEPATSGSETP | 435 | GGTAGCGAACCGGCAACCTCCGGCTCTGAA ACTCCAGGTACTTCTGAAAGCGCTACTCCG GAATCCGGCCCAGGTAGCGAACCGGCTACT TCCGGCTCTGAAACCCCA |
| LCW0402_051_GFP-N_B11.ab1 | 399 | GSEPATSGSETP GTSESATPESGP GSEPATSGSETP | 436 | GGTAGCGAACCGGCAACTTCCGGCTCTGAA ACCCCAGGTACTTCTGAAAGCGCTACTCCT GAGTCTGGCCCAGGTAGCGAACCTGCTACC TCTGGCTCTGAAACCCCA |
| LCW0402_059_GFP-N_E11.ab1 | 400 | GSEPATSGSETP GSEPATSGSETP GTSTEPSEGSAP | 437 | GGTAGCGAACCGGCAACCTCTGGCTCTGAA ACTCCAGGTAGCGAACCTGCAACCTCCGGC TCTGAAACCCCAGGTACTTCTACTGAACCTT CTGAGGGCAGCGCACCA |
| LCW0402_060_GFP-N_F11.ab1 | 401 | GTSESATPESGP GSEPATSGSETP GSEPATSGSETP | 438 | GGTACTTCTGAAAGCGCTACCCCGGAATCT GGCCCAGGTAGCGAACCGGCTACTTCTGGT TCTGAAACCCCAGGTAGCGAACCGGCTACC TCCGGTTCTGAAACTCCA |
| LCW0402_061_GFP-N_G11.ab1 | 402 | GTSTEPSEGSAP GTSTEPSEGSAP GTSESATPESGP | 439 | GGTACCTCTACTGAACCTTCCGAAGGCAGC GCTCCAGGTACCTCTACCGAACCGTCCGAG GGCAGCGCACCAGGTACTTCTGAAAGCGCA ACCCCTGAATCCGGTCCA |
| LCW0402_065_GFP-N_A12.ab1 | 403 | GSEPATSGSETP GTSESATPESGP GTSESATPESGP | 440 | GGTAGCGAACCGGCAACCTCTGGCTCTGAA ACCCCAGGTACCTCTGAAAGCGCTACTCCG GAATCTGGTCCAGGTACTTCTGAAAGCGCT ACTCCGGAATCCGGTCCA |
| LCW0402_066_GFP-N_B12.ab1 | 404 | GSEPATSGSETP GSEPATSGSETP GTSTEPSEGSAP | 441 | GGTAGCGAACCTGCTACCTCCGGCTCTGAA ACTCCAGGTAGCGAACCGGCTACTTCCGGT TCTGAAACTCCAGGTACCTCTACCGAACCTT CCGAAGGCAGCGCACCA |
| LCW0402_067_GFP-N_C12.ab1 | 405 | GSEPATSGSETP GTSTEPSEGSAP GSEPATSGSETP | 442 | GGTAGCGAACCTGCTACTTCTGGTTCTGAA ACTCCAGGTACTTCTACCGAACCGTCCGAG GGTAGCGCTCCAGGTAGCGAACCTGCTACT TCTGGTTCTGAAACTCCA |
| LCW0402_069_GFP-N_D12.ab1 | 406 | GTSTEPSEGSAP GTSTEPSEGSAP GSEPATSGSETP | 443 | GGTACCTCTACCGAACCGTCCGAGGGTAGC GCACCAGGTACCTCTACTGAACCGTCTGAG GGTAGCGCTCCAGGTAGCGAACCGGCAACC TCCGGTTCTGAAACTCCA |
| LCW0402_073_GFP-N_F12.ab1 | 407 | GTSTEPSEGSAP GSEPATSGSETP GSPAGSPTSTEE | 444 | GGTACTTCTACTGAACCTTCCGAAGGTAGC GCTCCAGGTAGCGAACCTGCTACTTCTGGTT CTGAAACCCCAGGTAGCCCGGCTGGCTCTC CGACCTCCACCGAGGAA |
| LCW0402_074_GFP-N_G12.ab1 | 408 | GSEPATSGSETP GSPAGSPTSTEE GTSESATPESGP | 445 | GGTAGCGAACCGGCTACTTCCGGCTCTGAG ACTCCAGGTAGCCCAGCTGGTTCTCCAACCT CTACTGAGGAAGGTACTTCTGAAAGCGCTA CCCCTGAATCTGGTCCA |

TABLE 13-continued

DNA and Amino Acid Sequences for 36-mer motifs

| File name | SEQ ID NO: | Amino acid sequence | SEQ ID NO: | Nucleotide sequence |
|---|---|---|---|---|
| LCW0402_075_GFP-N_H12.ab1 | 409 | GTSESATPESGP GSEPATSGSETP GTSESATPESGP | 446 | GGTACCTCTGAAAGCGCAACTCCTGAGTCT GGCCCAGGTAGCGAACCTGCTACCTCCGGC TCTGAGACTCCAGGTACCTCTGAAAGCGCA ACCCCGGAATCTGGTCCA |

Example 3

Construction of XTEN_AF36 Segments

A codon library encoding sequences of 36 amino acid length was constructed. The sequences were designated XTEN_AF36. Its segments have the amino acid sequence [α]₃ where X is a 12mer peptide with the sequence: GST-SESPSGTAP (SEQ ID NO: 447), GTSTPESGSASP (SEQ ID NO: 448), GTSPSGESSTAP (SEQ ID NO: 449), or GSTSSTAESPGP (SEQ ID NO: 450). The insert was obtained by annealing the following pairs of phosphorylated synthetic oligonucleotide pairs:

AF1for:
(SEQ ID NO: 451)
AGGTTCTACYAGCGAATCYCCKTCTGGYACYGCWCC

AF1rev:
(SEQ ID NO: 452)
ACCTGGWGCRGTRCCAGAMGGRGATTCGCTRGTAGA

AF2for:
(SEQ ID NO: 453)
AGGTACYTCTACYCCKGAAAGCGGYTCYGCWTCTCC

AF2rev:
(SEQ ID NO: 454)
ACCTGGAGAWGCRGARCCGCTTTCMGGRGTAGARGT

AF3for:
(SEQ ID NO: 455)
AGGTACYTCYCCKAGCGGYGAATCTTCTACYGCWCC

AF3rev:
(SEQ ID NO: 456)
ACCTGGWGCRGTAGAAGATTCRCCGCTMGGRGARGT

AF4for:
(SEQ ID NO: 457)
AGGTTCYACYAGCTCTACYGCWGAATCTCCKGGYCC

AF4rev:
(SEQ ID NO: 458)
ACCTGGRCCMGGAGATTCWGCRGTAGAGCTRGTRGA

We also annealed the phosphorylated oligonucleotide 3 KpnIstopperFor: AGGTTCGTCTTCACTCGAGGGTAC (SEQ ID NO: 459) and the non-phosphorylated oligonucleotide pr_3 KpnIstopperRev: CCTCGAGTGAAGACGA (SEQ ID NO: 460). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs and the SEQ ID NOS for these segments are listed in Table 14.

TABLE 14

DNA and Amino Acid Sequences for 36-mer motifs

| File name | SEQ ID NO: | Amino acid sequence | SEQ ID NO: | Nucleotide sequence |
|---|---|---|---|---|
| LCW0403_004_GFP-N_A01.ab1 | 461 | GTSTPESGSASPG TSPSGESSTAPGT SPSGESSTAP | 505 | GGTACTTCTACTCCGGAAAGCGGTTCCGCA TCTCCAGGTACTTCTCCTAGCGGTGAATCT TCTACTGCTCCAGGTACCTCTCCTAGCGGC GAATCTTCTACTGCTCCA |
| LCW0403_005_GFP-N_B01.ab1 | 462 | GTSPSGESSTAPG STSSTAESPGPGT SPSGESSTAP | 506 | GGTACTTCTCCGAGCGGTGAATCTTCTACC GCACCAGGTTCTACTAGCTCTACCGCTGAA TCTCCGGGCCCAGGTACTTCTCCGAGCGGT GAATCTTCTACTGCTCCA |
| LCW0403_006_GFP-N_C01.ab1 | 463 | GSTSSTAESPGPG TSPSGESSTAPGT STPESGSASP | 507 | GGTTCCACCAGCTCTACTGCTGAATCTCCT GGTCCAGGTACCTCTCCTAGCGGTGAATCT TCTACTGCTCCAGGTACTTCTACTCCTGAA AGCGGCTCTGCTTCTCCA |

TABLE 14-continued

DNA and Amino Acid Sequences for 36-mer motifs

| File name | SEQ ID NO: | Amino acid sequence | SEQ ID NO: | Nucleotide sequence |
|---|---|---|---|---|
| LCW0403_007_GFP-N_D01.ab1 | 464 | GSTSSTAESPGPGSTSSTAESPGPGTSPSGESSTAP | 508 | GGTTCTACCAGCTCTACTGCAGAATCTCCTGGCCCAGGTTCCACCAGCTCTACCGCAGAATCTCCGGGTCCAGGTACTTCCCCTAGCGGTGAATCTTCTACCGCACCA |
| LCW0403_008_GFP-N_E01.ab1 | 465 | GSTSSTAESPGPGTSPSGESSTAPGTSTPESGSASP | 509 | GGTTCTACTAGCTCTACTGCTGAATCTCCTGGCCCAGGTACTTCTCCTAGCGGTGAATCTTCTACCGCTCCAGGTACCTCTACTCCGGAAAGCGGTTCTGCATCTCCA |
| LCW0403_010_GFP-N_F01.ab1 | 466 | GSTSSTAESPGPGTSTPESGSASPGSTSESPSGTAP | 510 | GGTTCTACCAGCTCTACCGCAGAATCTCCTGGTCCAGGTACCTCTACTCCGGAAAGCGGCTCTGCATCTCCAGGTTCTACTAGCGAATCTCCTTCTGGCACTGCACCA |
| LCW0403_011_GFP-N_G01.ab1 | 467 | GSTSSTAESPGPGTSTPESGSASPGTSTPESGSASP | 511 | GGTTCTACTAGCTCTACTGCAGAATCTCCTGGCCCAGGTACCTCTACTCCGGAAAGCGGCTCTGCATCTCCAGGTACTTCTACCCCTGAAAGCGGTTCTGCATCTCCA |
| LCW0403_012_GFP-N_H01.ab1 | 468 | GSTSESPSGTAPGTSPSGESSTAPGSTSESPSGTAP | 512 | GGTTCTACCAGCGAATCTCCTTCTGGCACCGCTCCAGGTACCTCTCCTAGCGGCGAATCTTCTACCGCTCCAGGTTCTACTAGCGAATCTCCTTCTGGCACTGCACCA |
| LCW0403_013_GFP-N_A02.ab1 | 469 | GSTSSTAESPGPGSTSSTAESPGPGTSPSGESSTAP | 513 | GGTTCCACCAGCTCTACTGCAGAATCTCCGGGCCCAGGTTCTACTAGCTCTACTGCAGAATCTCCGGGTCCAGGTACTTCTCCTAGCGGCGAATCTTCTACCGCTCCA |
| LCW0403_014_GFP-N_B02.ab1 | 470 | GSTSSTAESPGPGTSTPESGSASPGSTSESPSGTAP | 514 | GGTTCCACTAGCTCTACTGCAGAATCTCCTGGCCCAGGTACCTCTACCCCTGAAAGCGGCTCTGCATCTCCAGGTTCTACCAGCGAATCCCGTCTGGCACCGCACCA |
| LCW0403_015_GFP-N_C02.ab1 | 471 | GSTSSTAESPGPGSTSSTAESPGPGTSPSGESSTAP | 515 | GGTTCTACTAGCTCTACTGCTGAATCTCCGGGTCCAGGTTCTACCAGCTCTACTGCTGAATCTCCTGGTCCAGGTACCTCCCCGAGCGGTGAATCTTCTACTGCACCA |
| LCW0403_017_GFP-N_D02.ab1 | 472 | GSTSSTAESPGPGSTSESPSGTAPGSTSSTAESPGP | 516 | GGTTCTACCAGCTCTACCGCTGAATCTCCTGGCCCAGGTTCTACCAGCGAATCCCCGTCTGGCACCGCACCAGGTTCTACTAGCTCTACCGCTGAATCTCCGGGTCCA |
| LCW0403_018_GFP-N_E02.ab1 | 473 | GSTSSTAESPGPGSTSSTAESPGPGSTSSTAESPGP | 517 | GGTTCTACCAGCTCTACCGCAGAATCTCCTGGCCCAGGTTCCACTAGCTCTACCGCTGAATCTCCTGGTCCAGGTTCTACTAGCTCTACCGCTGAATCTCCTGGTCCA |
| LCW0403_019_GFP-N_F02.ab1 | 474 | GSTSESPSGTAPGSTSSTAESPGPGSTSSTAESPGP | 518 | GGTTCTACTAGCGAATCCCCTTCTGGTACTGCTCCAGGTTCCACTAGCTCTACCGCTGAATCTCCTGGCCCAGGTTCCACTAGCTCTACTGCAGAATCTCCTGGTCCA |
| LCW0403_023_GFP-N_H02.ab1 | 475 | GSTSESPSGTAPGSTSESPSGTAPGSTSESPSGTAP | 519 | GGTTCTACTAGCGAATCTCCTTCTGGTACCGCTCCAGGTTCTACCAGCGAATCCCCGTCTGGTACTGCTCCAGGTTCTACCAGCGAATCTCCTTCTGGTACTGCACCA |
| LCW0403_024_GFP-N_A03.ab1 | 476 | GSTSSTAESPGPGSTSSTAESPGPGSTSSTAESPGP | 520 | GGTTCCACCAGCTCTACTGCTGAATCTCCTGGCCCAGGTTCTACCAGCTCTACTGCTGAATCTCCGGGCCCAGGTTCCACCAGCTCTACCGCTGAATCTCCGGGTCCA |
| LCW0403_025_GFP-N_B03.ab1 | 477 | GSTSSTAESPGPGSTSSTAESPGPGTSPSGESSTAP | 521 | GGTTCCACTAGCTCTACCGCAGAATCTCCTGGTCCAGGTTCTACTAGCTCTACTGCTGAATCTCCGGGTCCAGGTACCTCCCCTAGCGGCGAATCTTCTACCGCTCCA |
| LCW0403_028_GFP-N_D03.ab1 | 478 | GSSPSASTGTGPGSSTPSGATGSPGSSTPSGATGSP | 522 | GGTTCTAGCCCTTCTGCTTCCACCGGTACCGGCCCAGGTAGCTCTACTCCGTCTGGTGCAACTGGCTCTCCAGGTAGCTCTACTCCGTCTGGTGCAACCGGCTCCCCA |

TABLE 14-continued

DNA and Amino Acid Sequences for 36-mer motifs

| File name | SEQ ID NO: | Amino acid sequence | SEQ ID NO: | Nucleotide sequence |
|---|---|---|---|---|
| LCW0403_029_GFP-N_E03.ab1 | 479 | GTSPSGESSTAPG TSTPESGSASPGS TSSTAESPGP | 523 | GGTACTTCCCCTAGCGGTGAATCTTCTACT GCTCCAGGTACCTCTACTCCGGAAAGCGGC TCCGCATCTCCAGGTTCTACTAGCTCTACT GCTGAATCTCCTGGTCCA |
| LCW0403_030_GFP-N_F03.ab1 | 480 | GSTSSTAESPGPG STSSTAESPGPGT STPESGSASP | 524 | GGTTCTACTAGCTCTACCGCTGAATCTCCG GGTCCAGGTTCTACCAGCTCTACTGCAGAA TCTCCTGGCCCAGGTACTTCTACTCCGGAA AGCGGTTCCGCTTCTCCA |
| LCW0403_031_GFP-N_G03.ab1 | 481 | GTSPSGESSTAPG STSSTAESPGPGT STPESGSASP | 525 | GGTACTTCTCCTAGCGGTGAATCTTCTACC GCTCCAGGTTCTACCAGCTCTACTGCTGAA TCTCCTGGCCCAGGTACTTCTACCCCGGAA AGCGGCTCCGCTTCTCCA |
| LCW0403_033_GFP-N_H03.ab1 | 482 | GSTSESPSGTAPG STSSTAESPGPGS TSSTAESPGP | 526 | GGTTCTACTAGCGAATCCCCTTCTGGTACT GCACCAGGTTCTACCAGCTCTACTGCTGAA TCTCCGGGCCCAGGTTCCACCAGCTCTACC GCAGAATCTCCTGGTCCA |
| LCW0403_035_GFP-N_A04.ab1 | 483 | GSTSSTAESPGPG STSESPSGTAPGS TSSTAESPGP | 527 | GGTTCCACCAGCTCTACCGCTGAATCTCCG GGCCCAGGTTCTACCAGCGAATCCCCTTCT GGCACTGCACCAGGTTCTACTAGCTCTACC GCAGAATCTCCGGGCCCA |
| LCW0403_036_GFP-N_B04.ab1 | 484 | GSTSSTAESPGPG TSPSGESSTAPGT STPESGSASP | 528 | GGTTCTACCAGCTCTACTGCTGAATCTCCG GGTCCAGGTACTTCCCCGAGCGGTGAATCT TCTACTGCACCAGGTACTTCTACTCCGGAA AGCGGTTCCGCTTCTCCA |
| LCW0403_039_GFP-N_C04.ab1 | 485 | GSTSESPSGTAPG STSESPSGTAPGT SPSGESSTAP | 529 | GGTTCTACCAGCGAATCTCCTTCTGGCACC GCTCCAGGTTCTACTAGCGAATCCCCGTCT GGTACCGCACCAGGTACTTCTCCTAGCGGC GAATCTTCTACCGCACCA |
| LCW0403_041_GFP-N_D04.ab1 | 486 | GSTSESPSGTAPG STSESPSGTAPGT STPESGSASP | 530 | GGTTCTACCAGCGAATCCCCTTCTGGTACT GCTCCAGGTTCTACCAGCGAATCCCCTTCT GGCACCGCACCAGGTACTTCTACCCCTGAA AGCGGCTCCGCTTCTCCA |
| LCW0403_044_GFP-N_E04.ab1 | 487 | GTSTPESGSASPG STSSTAESPGPGS TSSTAESPGP | 531 | GGTACCTCTACTCCTGAAAGCGGTTCTGCA TCTCCAGGTTCCACTAGCTCTACCGCAGAA TCTCCGGGCCCAGGTTCTACTAGCTCTACT GCTGAATCTCCTGGCCCA |
| LCW0403_046_GFP-N_F04.ab1 | 488 | GSTSESPSGTAPG STSESPSGTAPGT SPSGESSTAP | 532 | GGTTCTACCAGCGAATCCCCTTCTGGCACT GCACCAGGTTCTACTAGCGAATCCCCTTCT GGTACCGCACCAGGTACTTCTCCGAGCGGC GAATCTTCTACTGCTCCA |
| LCW0403_047_GFP-N_G04.ab1 | 489 | GSTSSTAESPGPG STSSTAESPGPGS TSESPSGTAP | 533 | GGTTCTACTAGCTCTACCGCTGAATCTCCT GGCCCAGGTTCCACTAGCTCTACCGCAGAA TCTCCGGGCCCAGGTTCTACTAGCGAATCC CCTTCTGGTACCGCTCCA |
| LCW0403_049_GFP-N_H04.ab1 | 490 | GSTSSTAESPGPG STSSTAESPGPGT STPESGSASP | 534 | GGTTCCACCAGCTCTACTGCAGAATCTCCT GGCCCAGGTTCTACTAGCTCTACCGCAGAA TCTCCTGGTCCAGGTACCTCTACTCCTGAA AGCGGTTCCGCATCTCCA |
| LCW0403_051_GFP-N_A05.ab1 | 491 | GSTSSTAESPGPG STSSTAESPGPGS TSESPSGTAP | 535 | GGTTCTACTAGCTCTACTGCTGAATCTCCG GGCCCAGGTTCTACTAGCTCTACCGCTGAA TCTCCGGGTCCAGGTTCTACTAGCGAATCT CCTTCTGGTACCGCTCCA |
| LCW0403_053_GFP-N_B05.ab1 | 492 | GTSPSGESSTAPG STSESPSGTAPGS TSSTAESPGP | 536 | GGTACCTCCCCGAGCGGTGAATCTTCTACT GCACCAGGTTCTACTAGCGAATCCCCTTCT GGTACTGCTCCAGGTTCCACCAGCTCTACT GCAGAATCTCCGGGTCCA |
| LCW0403_054_GFP-N_C05.ab1 | 493 | GSTSESPSGTAPG TSPSGESSTAPGS TSSTAESPGP | 537 | GGTTCTACTAGCGAATCCCCGTCTGGTACT GCTCCAGGTACTTCCCCTAGCGGTGAATCT TCTACTGCTCCAGGTTCTACCAGCTCTACC GCAGAATCTCCGGGTCCA |

TABLE 14-continued

DNA and Amino Acid Sequences for 36-mer motifs

| File name | SEQ ID NO: | Amino acid sequence | SEQ ID NO: | Nucleotide sequence |
|---|---|---|---|---|
| LCW0403_057_GFP-N_D05.ab1 | 494 | GSTSSTAESPGPG STSESPSGTAPGT SPSGESSTAP | 538 | GGTTCTACCAGCTCTACCGCTGAATCTCCT GGCCCAGGTTCTACTAGCGAATCTCCGTCT GGCACCGCACCAGGTACTTCCCCTAGCGGT GAATCTTCTACTGCACCA |
| LCW0403_058_GFP-N_E05.ab1 | 495 | GSTSESPSGTAPG STSESPSGTAPGT STPESGSASP | 539 | GGTTCTACTAGCGAATCTCCTTCTGGCACT GCACCAGGTTCTACCAGCGAATCTCCGTCT GGCACTGCACCAGGTACCTCTACCCCTGAA AGCGGTTCCGCTTCTCCA |
| LCW0403_060_GFP-N_F05.ab1 | 496 | GTSTPESGSASPG STSESPSGTAPGS TSSTAESPGP | 540 | GGTACCTCTACTCCGGAAAGCGGTTCCGCA TCTCCAGGTTCTACCAGCGAATCCCCGTCT GGCACCGCACCAGGTTCTACTAGCTCTACT GCTGAATCTCCGGGCCCA |
| LCW0403_063_GFP-N_G05.ab1 | 497 | GSTSSTAESPGPG TSPSGESSTAPGT SPSGESSTAP | 541 | GGTTCTACTAGCTCTACTGCAGAATCTCCG GGCCCAGGTACCTCTCCTAGCGGTGAATCT TCTACCGCTCCAGGTACTTCTCCGAGCGGT GAATCTTCTACCGCTCCA |
| LCW0403_064_GFP-N_H05.ab1 | 498 | GTSPSGESSTAPG TSPSGESSTAPGT SPSGESSTAP | 542 | GGTACCTCCCCTAGCGGCGAATCTTCTACT GCTCCAGGTACCTCTCCTAGCGGCGAATCT TCTACCGCTCCAGGTACCTCCCCTAGCGGT GAATCTTCTACCGCACCA |
| LCW0403_065_GFP-N_A06.ab1 | 499 | GSTSSTAESPGPG TSTPESGSASPGS TSESPSGTAP | 543 | GGTTCCACTAGCTCTACTGCTGAATCTCCT GGCCCAGGTACTTCTACTCCGGAAAGCGGT TCCGCTTCTCCAGGTTCTACTAGCGAATCT CCGTCTGGCACCGCACCA |
| LCW0403_066_GFP-N_B06.ab1 | 500 | GSTSESPSGTAPG TSPSGESSTAPGT SPSGESSTAP | 544 | GGTTCTACTAGCGAATCTCCGTCTGGCACT GCTCCAGGTACTTCTCCTAGCGGTGAATCT TCTACCGCTCCAGGTACTTCCCCTAGCGGC GAATCTTCTACCGCTCCA |
| LCW0403_067_GFP-N_C06.ab1 | 501 | GSTSESPSGTAPG TSTPESGSASPGS TSSTAESPGP | 545 | GGTTCTACTAGCGAATCTCCTTCTGGTACC GCTCCAGGTACTTCTACCCCTGAAAGCGGC TCCGCTTCTCCAGGTTCCACTAGCTCTACC GCTGAATCTCCGGGTCCA |
| LCW0403_068_GFP-N_D06.ab1 | 502 | GSTSSTAESPGPG STSSTAESPGPGS TSESPSGTAP | 546 | GGTTCCACTAGCTCTACTGCTGAATCTCCT GGCCCAGGTTCTACCAGCTCTACCGCTGAA TCTCCTGGCCCAGGTTCTACCAGCGAATCT CCGTCTGGCACCGCACCA |
| LCW0403_069_GFP-N_E06.ab1 | 503 | GSTSESPSGTAPG TSTPESGSASPGT STPESGSASP | 547 | GGTTCTACTAGCGAATCCCCGTCTGGTACC GCACCAGGTACTTCTACCCCGGAAAGCGG CTCTGCTTCTCCAGGTACTTCTACCCCGGA AAGCGGCTCCGCATCTCCA |
| LCW0403_070_GFP-N_F06.ab1 | 504 | GSTSESPSGTAPG TSTPESGSASPGT STPESGSASP | 548 | GGTTCTACTAGCGAATCCCCGTCTGGTACT GCTCCAGGTACTTCTACTCCTGAAAGCGGT TCCGCTTCTCCAGGTACCTCTACTCCGGAA AGCGGTTCTGCATCTCCA |

Example 4

Construction of XTEN_AG36 Segments

A codon library encoding sequences of 36 amino acid length was constructed. The sequences were designated XTEN_AG36. Its segments have the amino acid sequence $[\alpha]_3$ where X is a 12mer peptide with the sequence: GTPGSGTASSSP (SEQ ID NO: 549), GSSTPSGATGSP (SEQ ID NO: 550), GSSPSASTGTGP (SEQ ID NO: 551), or GASPGTSSTGSP (SEQ ID NO: 552). The insert was obtained by annealing the following pairs of phosphorylated synthetic oligonucleotide pairs:

AG1for:
(SEQ ID NO: 553)
AGGTACYCCKGGYAGCGGTACYGCWTCTTCYTCTCC

AG1rev:
(SEQ ID NO: 554)
ACCTGGAGARGAAGAWGCRGTACCGCTRCCMGGRGT

AG2for:
(SEQ ID NO: 555)
AGGTAGCTCTACYCCKTCTGGTGCWACYGGYTCYCC

AG2rev:
(SEQ ID NO: 556)
ACCTGGRGARCCRGTWGCACCAGAMGGRGTAGAGCT

```
AG3for:
                                            (SEQ ID NO: 557)
AGGTTCTAGCCCKTCTGCWTCYACYGGTACYGGYCC AG3rev:
                                            (SEQ ID NO: 558)
ACCTGGRCCRGTACCRGTRGAWGCAGAMGGGCTAGA AG4for:
                                            (SEQ ID NO: 559)
AGGTGCWTCYCCKGGYACYAGCTCTACYGGTTCTCC AG4rev:
                                            (SEQ ID NO: 560)
ACCTGGAGAACCRGTAGAGCTRGTRCCMGGRGAWGC
```

We also annealed the phosphorylated oligonucleotide 3 KpnIstopperFor: AGGTTCGTCTTCACTCGAGGGTAC (SEQ ID NO: 561) and the non-phosphorylated oligonucleotide pr_3 KpnIstopperRev: CCTCGAGTGAAGACGA (SEQ ID NO: 562). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs and the SEQ ID NOS for these segments are listed in Table 15.

TABLE 15

DNA and Amino Acid Sequences for 36-mer motifs

| File name | SEQ ID NO: | Amino acid sequence | SEQ ID NO: | Nucleotide sequence |
|---|---|---|---|---|
| LCW0404_001_GFP-N_A07.ab1 | 563 | GASPGTSSTGSP GTPGSGTASSSP GSSTPSGATGSP | 607 | GGTGCATCCCCGGGCACTAGCTCTACCGG TTCTCCAGGTACTCCTGGTAGCGGTACTG CTTCTTCTTCTCCAGGTAGCTCTACTCCTT CTGGTGCTACTGGTTCTCCA |
| LCW0404_003_GFP-N_B07.ab1 | 564 | GSSTPSGATGSP GSSPSASTGTGP GSSTPSGATGSP | 608 | GGTAGCTCTACCCCTTCTGGTGCTACCGG CTCTCCAGGTTCTAGCCCGTCTGCTTCTAC CGGTACCGGTCCAGGTAGCTCTACCCCTT CTGGTGCTACTGGTTCTCCA |
| LCW0404_006_GFP-N_C07.ab1 | 565 | GASPGTSSTGSP GSSPSASTGTGP GSSTPSGATGSP | 609 | GGTGCATCTCCGGGTACTAGCTCTACCGG TTCTCCAGGTTCTAGCCCTTCTGCTTCCAC TGGTACCGGCCCAGGTAGCTCTACCCCGT CTGGTGCTACTGGTTCTCCA |
| LCW0404_007_GFP-N_D07.ab1 | 566 | GTPGSGTASSSP GSSTPSGATGSP GASPGTSSTGSP | 610 | GGTACTCCGGGCAGCGGTACTGCTTCTTC CTCTCCAGGTAGCTCTACCCCTTCTGGTGC AACTGGTTCCCAGGTGCATCCCCTGGTA CTAGCTCTACCGGTTCTCCA |
| LCW0404_009_GFP-N_E07.ab1 | 567 | GTPGSGTASSSP GASPGTSSTGSP GSRPSASTGTGP | 611 | GGTACCCCTGGCAGCGGTACTGCTTCTTC TTCTCCAGGTGCTTCCCCTGGTACCAGCTC TACCGGTTCTCCAGGTTCTAGACCTTCTGC ATCCACCGGTACTGGTCCA |
| LCW0404_011_GFP-N_F07.ab1 | 568 | GASPGTSSTGSP GSSTPSGATGSP GASPGTSSTGSP | 612 | GGTGCATCTCCTGGTACCAGCTCTACCGG TTCTCCAGGTAGCTCTACTCCTTCTGGTGC TACTGGCTCTCAGGTGCTTCCCCGGGTA CCAGCTCTACCGGTTCTCCA |
| LCW0404_012_GFP-N_G07.ab1 | 569 | GTPGSGTASSSP GSSTPSGATGSP GSSTPSGATGSP | 613 | GGTACCCCGGGCAGCGGTACCGCATCTTC CTCTCCAGGTAGCTCTACCCCGTCTGGTG CTACCGGTTCCCCAGGTAGCTCTACCCCG TCTGGTGCAACCGGCTCCCA |
| LCW0404_014_GFP-N_H07.ab1 | 570 | GASPGTSSTGSP GASPGTSSTGSP GASPGTSSTGSP | 614 | GGTGCATCTCCGGGCACTAGCTCTACTGG TTCTCCAGGTGCATCCCCTGGCACTAGCT CTACTGGTTCTCCAGGTGCTTCTCCTGGTA CCAGCTCTACTGGTTCTCCA |
| LCW0404_015_GFP-N_A08.ab1 | 571 | GSSTPSGATGSP GSSPSASTGTGP GASPGTSSTGSP | 615 | GGTAGCTCTACTCCGTCTGGTGCAACCGG CTCCCCAGGTTCTAGCCCGTCTGCTTCCAC TGGTACTGGCCCAGGTGCTTCCCCGGGCA CCAGCTCTACTGGTTCTCCA |
| LCW0404_016_GFP-N_B08.ab1 | 572 | GSSTPSGATGSP GSSTPSGATGSP GTPGSGTASSSP | 616 | GGTAGCTCTACTCCTTCTGGTGCTACCGGT TCCCCAGGTAGCTCTACTCCTTCTGGTGCT ACTGGTTCCCCAGGTACTCCGGGCAGCGG TACTGCTTCTTCCTCTCCA |

TABLE 15-continued

DNA and Amino Acid Sequences for 36-mer motifs

| File name | SEQ ID NO: | Amino acid sequence | SEQ ID NO: | Nucleotide sequence |
|---|---|---|---|---|
| LCW0404_017_GFP-N_C08.ab1 | 573 | GSSTPSGATGSP GSSTPSGATGSP GASPGTSSTGSP | 617 | GGTAGCTCTACTCCGTCTGGTGCAACCGG TTCCCCAGGTAGCTCTACTCCTTCTGGTGC TACTGGCTCCCCAGGTGCATCCCCTGGCA CCAGCTCTACCGGTTCTCCA |
| LCW0404_018_GFP-N_D08.ab1 | 574 | GTPGSGTASSSP GSSPSASTGTGP GSSTPSGATGSP | 618 | GGTACTCCTGGTAGCGGTACCGCATCTTC CTCTCCAGGTTCTAGCCCTTCTGCATCTAC CGGTACCGGTCCAGGTAGCTCTACTCCTT CTGGTGCTACTGGCTCTCCA |
| LCW0404_023_GFP-N_F08.ab1 | 575 | GASPGTSSTGSP GSSPSASTGTGP GTPGSGTASSSP | 619 | GGTGCTTCCCCGGGCACTAGCTCTACCGG TTCTCCAGGTTCTAGCCCTTCTGCATCTAC TGGTACTGGCCCAGGTACTCCGGGCAGCG GTACTGCTTCTTCCTCTCCA |
| LCW0404_025_GFP-N_G08.ab1 | 576 | GSSTPSGATGSP GSSTPSGATGSP GASPGTSSTGSP | 620 | GGTAGCTCTACTCCGTCTGGTGCTACCGG CTCTCCAGGTAGCTCTACCCCTTCTGGTGC AACCGGCTCCCAGGTGCTTCTCCGGGTA CCAGCTCTACTGGTTCTCCA |
| LCW0404_029_GFP-N_A09.ab1 | 577 | GTPGSGTASSSP GSSTPSGATGSP GSSPSASTGTGP | 621 | GGTACCCCTGGCAGCGGTACCGCTTCTTC CTCTCCAGGTAGCTCTACCCCGTCTGGTG CTACTGGCTCTCCAGGTTCTAGCCCGTCTG CATCTACCGGTACCGGCCCA |
| LCW0404_030_GFP-N_B09.ab1 | 578 | GSSTPSGATGSP GTPGSGTASSSP GTPGSGTASSSP | 622 | GGTAGCTCTACTCCTTCTGGTGCAACCGG CTCCCCAGGTACCCCGGGCAGCGGTACCG CATCTTCCTCTCCAGGTACTCCGGGTAGC GGTACTGCTTCTTCTTCTCCA |
| LCW0404_031_GFP-N_C09.ab1 | 579 | GTPGSGTASSSP GSSTPSGATGSP GASPGTSSTGSP | 623 | GGTACCCCGGGTAGCGGTACTGCTTCTTC CTCTCCAGGTAGCTCTACCCCTTCTGGTGC AACCGGCTCTCCAGGTGCTTCTCCGGGCA CCAGCTCTACCGGTTCTCCA |
| LCW0404_034_GFP-N_D09.ab1 | 580 | GSSTPSGATGSP GSSTPSGATGSP GASPGTSSTGSP | 624 | GGTAGCTCTACCCCGTCTGGTGCTACCGG CTCTCCAGGTAGCTCTACCCCGTCTGGTG CAACCGGCTCCCCAGGTGCATCCCCGGGT ACTAGCTCTACCGGTTCTCCA |
| LCW0404_035_GFP-N_E09.ab1 | 581 | GASPGTSSTGSP GTPGSGTASSSP GSSTPSGATGSP | 625 | GGTGCTTCTCCGGGCACCAGCTCTACTGG TTCTCCAGGTACCCCGGGCAGCGGTACCG CATCTTCTTCTCCAGGTAGCTCTACTCCTT CTGGTGCAACTGGTTCTGCA |
| LCW0404_036_GFP-N_F09.ab1 | 582 | GSSPSASTGTGP GSSTPSGATGSP GTPGSGTASSSP | 626 | GGTTCTAGCCCGTCTGCTTCCACCGGTACT GGCCCAGGTAGCTCTACCCCGTCTGGTGC AACTGGTTCCCCAGGTACCCCTGGTAGCG GTACCGCTTCTTCTTCTCCA |
| LCW0404_037_GFP-N_G09.ab1 | 583 | GASPGTSSTGSP GSSPSASTGTGP GSSTPSGATGSP | 627 | GGTGCTTCTCCGGGCACCAGCTCTACTGG TTCTCCAGGTTCTAGCCCTTCTGCATCCAC CGGTACCGGTCCAGGTAGCTCTACCCCTT CTGGTGCAACCGGCTCTCCA |
| LCW0404_040_GFP-N_H09.ab1 | 584 | GASPGTSSTGSP GSSTPSGATGSP GSSTPSGATGSP | 628 | GGTGCATCCCCGGGCACCAGCTCTACCGG TTCTCCAGGTAGCTCTACCCCGTCTGGTGC TACCGGCTCTCCAGGTAGCTCTACCCCGT CTGGTGCTACTGGCTCTCCA |
| LCW0404_041_GFP-N_A10.ab1 | 585 | GTPGSGTASSSP GSSTPSGATGSP GTPGSGTASSSP | 629 | GGTACCCCTGGTAGCGGTACTGCTTCTTC CTCTCCAGGTAGCTCTACTCCGTCTGGTGC TACCGGTTCTCCAGGTACCCCGGGTAGCG GTACCGCATCTTCTTCTCCA |
| LCW0404_043_GFP-N_C10.ab1 | 586 | GSSPSASTGTGP GSSTPSGATGSP GSSTPSGATGSP | 630 | GGTTCTAGCCCTTCTGCTTCCACCGGTACT GGCCCAGGTAGCTCTACCCCTTCTGGTGC TACCGGCTCCCAGGTAGCTCTACTCCTTC TGGTGCAACTGGCTCTCCA |
| LCW0404_045_GFP-N_D10.ab1 | 587 | GASPGTSSTGSP GSSPSASTGTGP GSSPSASTGTGP | 631 | GGTGCTTCTCCTGGCACCAGCTCTACTGG TTCTCCAGGTTCTAGCCCTTCTGCTTCTAC CGGTACTGGTCCAGGTTCTAGCCCTTCTG CATCCACTGGTACTGGTCCA |

TABLE 15-continued

DNA and Amino Acid Sequences for 36-mer motifs

| File name | SEQ ID NO: | Amino acid sequence | SEQ ID NO: | Nucleotide sequence |
|---|---|---|---|---|
| LCW0404_047_GFP-N_F10.ab1 | 588 | GTPGSGTASSSP GASPGTSSTGSP GASPGTSSTGSP | 632 | GGTACTCCTGGCAGCGGTACCGCTTCTTC TTCTCCAGGTGCTTCTCCTGGTACTAGCTC TACTGGTTCTCCAGGTGCTTCTCCGGGCA CTAGCTCTACTGGTTCTCCA |
| LCW0404_048_GFP-N_G10.ab1 | 589 | GSSTPSGATGSP GASPGTSSTGSP GSSTPSGATGSP | 633 | GGTAGCTCTACCCCGTCTGGTGCTACCGG TTCCCCAGGTGCTTCTCCTGGTACTAGCTC TACCGGTTCTCCAGGTAGCTCTACCCCGT CTGGTGCTACTGGCTCTCCA |
| LCW0404_049_GFP-N_H10.ab1 | 590 | GSSTPSGATGSP GTPGSGTASSSP GSSTPSGATGSP | 634 | GGTAGCTCTACCCCGTCTGGTGCTACTGG TTCTCCAGGTACTCCGGGCAGCGGTACTG CTTCTTCCTCTCCAGGTAGCTCTACCCCTT CTGGTGCTACTGGCTCTCCA |
| LCW0404_050_GFP-N_A11.ab1 | 591 | GASPGTSSTGSP GSSPSASTGTGP GSSTPSGATGSP | 635 | GGTGCATCTCCTGGTACCAGCTCTACTGG TTCTCCAGGTTCTAGCCCTTCTGCTTCTAC CGGTACCGGTCCAGGTAGCTCTACTCCTT CTGGTGCTACCGGTTCTCCA |
| LCW0404_051_GFP-N_B11.ab1 | 592 | GSSTPSGATGSP GSSTPSGATGSP GSSTPSGATGSP | 636 | GGTAGCTCTACCCCGTCTGGTGCTACTGG CTCTCCAGGTAGCTCTACTCCTTCTGGTGC TACTGGTTCCCCAGGTAGCTCTACCCCGT CTGGTGCAACTGGCTCTCCA |
| LCW0404_052_GFP-N_C11.ab1 | 593 | GASPGTSSTGSP GTPGSGTASSSP GASPGTSSTGSP | 637 | GGTGCATCCCGGGTACCAGCTCTACCGG TTCTCCAGGTACTCCTGGCAGCGGTACTG CATCTTCCTCTCCAGGTGCTTCTCCGGGCA CCAGCTCTACTGGTTCTCCA |
| LCW0404_053_GFP-N_D11.ab1 | 594 | GSSTPSGATGSP GSSPSASTGTGP GASPGTSSTGSP | 638 | GGTAGCTCTACTCCTTCTGGTGCAACTGG TTCTCCAGGTTCTAGCCCGTCTGCATCCAC TGGTACCGGTCCAGGTGCTTCCCCTGGCA CCAGCTCTACCGGTTCTCCA |
| LCW0404_057_GFP-N_E11.ab1 | 595 | GASPGTSSTGSP GSSTPSGATGSP GSSPSASTGTGP | 639 | GGTGCATCTCCTGGTACTAGCTCTACTGG TTCTCCAGGTAGCTCTACTCCGTCTGGTGC AACCGGCTCTCCAGGTTCTAGCCCTTCTG CATCTACCGGTACTGGTCCA |
| LCW0404_060_GFP-N_F11.ab1 | 596 | GTPGSGTASSSP GSSTPSGATGSP GASPGTSSTGSP | 640 | GGTACTCCTGGCAGCGGTACCGCATCTTC CTCTCCAGGTAGCTCTACTCCGTCTGGTGC AACTGGTTCCCCAGGTGCTTCTCCGGGTA CCAGCTCTACCGGTTCTCCA |
| LCW0404_062_GFP-N_G11.ab1 | 597 | GSSTPSGATGSP GTPGSGTASSSP GSSTPSGATGSP | 641 | GGTAGCTCTACCCCGTCTGGTGCAACCGG CTCCCCAGGTACTCCTGGTAGCGGTACCG CTTCTTCTTCTCCAGGTAGCTCTACTCCGT CTGGTGCTACCGGCTCCCCA |
| LCW0404_066_GFP-N_H11.ab1 | 598 | GSSPSASTGTGP GSSPSASTGTGP GASPGTSSTGSP | 642 | GGTTCTAGCCCTTCTGCATCCACCGGTAC CGGCCCAGGTTCTAGCCCGTCTGCTTCTA CCGGTACTGGTCCAGGTGCTTCTCCGGGT ACTAGCTCTACTGGTTCTCCA |
| LCW0404_067_GFP-N_A12.ab1 | 599 | GTPGSGTASSSP GSSTPSGATGSP GSNPSASTGTGP | 643 | GGTACCCCGGGTAGCGGTACCGCTTCTTC TTCTCCAGGTAGCTCTACTCCGTCTGGTGC TACCGGCTCTCCAGGTTCTAACCCTTCTGC ATCCACCGGTACCGGCCCA |
| LCW0404_068_GFP-N_B12.ab1 | 600 | GSSPSASTGTGP GSSTPSGATGSP GASPGTSSTGSP | 644 | GGTTCTAGCCCTTCTGCATCTACTGGTACT GGCCCAGGTAGCTCTACTCCTTCTGGTGC TACCGGCTCTCCAGGTGCTTCTCCGGGTA CTAGCTCTACCGGTTCTCCA |
| LCW0404_069_GFP-N_C12.ab1 | 601 | GSSTPSGATGSP GASPGTSSTGSP GTPGSGTASSSP | 645 | GGTAGCTCTACCCCTTCTGGTGCAACCGG CTCTCCAGGTGCATCCCCGGGTACCAGCT CTACCGGTTCTCCAGGTACTCCGGGTAGC GGTACCGCTTCTTCCTCTCCA |

TABLE 15-continued

DNA and Amino Acid Sequences for 36-mer motifs

| File name | SEQ ID NO: | Amino acid sequence | SEQ ID NO: | Nucleotide sequence |
|---|---|---|---|---|
| LCW0404_070_GFP-N_D12.ab1 | 602 | GSSTPSGATGSP GSSTPSGATGSP GSSTPSGATGSP | 646 | GGTAGCTCTACTCCGTCTGGTGCAACCGG TTCCCCAGGTAGCTCTACCCCTTCTGGTGC AACCGGCTCCCCAGGTAGCTCTACCCCTT CTGGTGCAACTGGCTCTCCA |
| LCW0404_073_GFP-N_E12.ab1 | 603 | GASPGTSSTGSP GTPGSGTASSSP GSSTPSGATGSP | 647 | GGTGCTTCTCCTGGCACTAGCTCTACCGG TTCTCCAGGTACCCCTGGTAGCGGTACCG CATCTTCCTCTCCAGGTAGCTCTACTCCTT CTGGTGCTACTGGTTCCCCA |
| LCW0404_075_GFP-N_F12.ab1 | 604 | GSSTPSGATGSP GSSPSASTGTGP GSSPSASTGTGP | 648 | GGTAGCTCTACCCCGTCTGGTGCTACTGG CTCCCCAGGTTCTAGCCCTTCTGCATCCAC CGGTACCGGTCCAGGTTCTAGCCCGTCTG CATCTACTGGTACTGGTCCA |
| LCW0404_080_GFP-N_G12.ab1 | 605 | GASPGTSSTGSP GSSPSASTGTGP GSSPSASTGTGP | 649 | GGTGCTTCCCCGGGCACCAGCTCTACTGG TTCTCCAGGTTCTAGCCCGTCTGCTTCTAC TGGTACTGGTCCAGGTTCTAGCCCTTCTGC TTCCACTGGTACTGGTCCA |
| LCW0404_081_GFP-N_H12.ab1 | 606 | GASPGTSSTGSP GSSPSASTGTGP GTPGSGTASSSP | 650 | GGTGCTTCCCCGGGTACCAGCTCTACCGG TTCTCCAGGTTCTAGCCCTTCTGCTTCTAC CGGTACCGGTCCAGGTACCCTGGCAGCG GTACCGCATCTTCCTCTCCA |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of E. coli that harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm. 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs and the SEQ ID NOS for these segments are listed in Table 16.

TABLE 16

DNA and amino acid sequences for AM144 segments

| Clone | SEQ ID NO: | Sequence Trimmed | SEQ ID NO: | Protein Sequence |
|---|---|---|---|---|
| LCW462_r1 | 651 | GGTACCCCGGGCAGCGGTACCGCATCT TCCTCTCCAGGTAGCTCTACCCCGTCTG GTGCTACCGGTTCCCCAGGTAGCTCTA CCCCGTCTGGTGCAACCGGCTCCCCAG GTAGCCCGGCTGGCTCTCCTACCTCTA CTGAGGAAGGTACTTCTGAAAGCGCTA CTCCTGAGTCTGGTCCAGGTACCTCTA CTGAACCGTCCGAAGGTAGCGCTCCAG GTTCTAGCCCTTCTGCATCCACCGGTA CCGGCCCAGGTTCTAGCCCGTCTGCTT CTACCGGTACTGGTCCAGGTGCTTCTC CGGGTACTAGCTCTACTGGTTCTCCAG GTACCTCTACCGAACCGTCCGAGGGTA GCGCACCAGGTACCTCTACTGAACCGT CTGAGGGTAGCGCTCCAGGTAGCGAAC CGGCAACCTCCGGTTCTGAAACTCCA | 684 | GTPGSGTASSSPGSSTPSG ATGSPGSSTPSGATGSPGS PAGSPTSTEEGTSESATPES GPGTSTEPSEGSAPGSSPSA STGTGPGSSPSASTGTGPG ASPGTSSTGSPGTSTEPSEG SAPGTSTEPSEGSAPGSEPA TSGSETP |
| LCW462_r5 | 652 | GGTTCTACCAGCGAATCCCCTTCTGGC ACTGCACCAGGTTCTACTAGCGAATCC CCTTCTGGTACCGCACCAGGTACTTCC CCGAGCGGCGAATCTTCTACTGCTCCA GGTACCTCTACTGAACCTTCCGAAGGC AGCGCTCCAGGTACCTCTACCGAACCG TCCGAGGGCAGCGCACCAGGTACTTCT GAAAGCGCAACCCCTGAATCCGGTCCA GGTGCATCCTCCTGGTACCAGCTCTACC GGTTCTCCAGGTAGCTCTACTCCTTCTG GTGCTACTGGCTCTCCAGGTGCTTCCC CGGGTACCAGCTCTACCGGTTCTCCAG GTTCTACTAGCGAATCTCCTTCTGGCA CTGCACCAGGTTCTACCAGCGAATCTC CGTCTGGCACTGCACCAGGTACCTCTA CCCCTGAAAGCGGTTCCGCTTCTCCA | 685 | GSTSESPSGTAPGSTSESPS GTAPGTSPSGESSTAPGTS TEPSEGSAPGTSTEPSEGSA PGTSESATPESGPASPGTS STGSPGSSTPSGATGSPGA SPGTSSTGSPGSTSESPSGT APGSTSESPSGTAPGTSTPE SGSASP |
| LCW462_r9 | 653 | GGTACTTCTACCGAACCTTCCGAGGGC AGCGCACCAGGTACTTCTGAAAGCGCT ACCCCTGAGTCCGGCCCAGGTACTTCT GAAAGCGCTACTCCTGAATCCGGTCCA GGTACCTCTACTGAACCTTCTGAGGGC AGCGCTCCAGGTACTTCTGAAAGCGCT ACCCCGGAGTCCGGTCCAGGTACTTCT ACTGAACCGTCCGAAGGTAGCGCACCA GGTACTTCTACTGAACCTTCCGAAGGT AGCGCTCCAGGTAGCGAACCTGCTACT TCTGGTTCTGAAACCCCAGGTAGCCCG GCTGGCTCTCCGACCTCCACCGAGGAA GGTGCTTCTCCTGGCACCAGCTCTACT GGTTCTCCAGGTTCTAGCCCTTCTGCTT CTACCGGTACTGGTCCAGGTTCTAGCC CTTCTGCATCCACTGGTACTGGTCCA | 686 | GTSTEPSEGSAPGTSESATP ESGPGTSESATPESGPGTST EPSEGSAPGTSESATPESGP GTSTEPSEGSAPGTSTEPSE GSAPGSEPATSGSETPGSP AGSPTSTEEGASPGTSSTG SPGSSPSASTGTGPGSSPSA STGTGP |
| LCW462_r10 | 654 | GGTAGCGAACCGGCAACCTCTGGCTCT GAAACCCCAGGTACCTCTGAAAGCGCT ACTCCGGAATCTGGTCCAGGTACTTCT GAAAGCGCTACTCCGGAATCCGGTCCA GGTTCTACCAGCGAATCTCCTTCTGGC ACCGCTCCAGGTTCTACTAGCGAATCC CCGTCTGGTACCGCACCAGGTACTTCT CCTAGCGGCGAATCTTCTACCGCACCA GGTGCATCTCCGGGTACTAGCTCTACC GGTTCTCCAGGTTCTAGCCCTTCTGCTT CCACTGGTACCGGCCCAGGTAGCTCTA CCCGTCTGGTGCTACTGGTTCCCCAG GTAGCTCTACTCCGTCTGGTGCAACCG GTTCCCCAGGTAGCTCTACTCCTTCTGG TGCTACTGGCTCCCCAGGTGCATCCCC TGGCACCAGCTCTACCGGTTCTCCA | 687 | GSEPATSGSETPGTSESATP ESGPGTSESATPESGPGSTS ESPSGTAPGSTSESPSGTAP GTSPSGESSTAPGASPGTSS TGSPGSSPSASTGTGPGSST PSGATGSPGSSTPSGATGS PGSSTPSGATGSPGASPGT SSTGSP |
| LCW462_r15 | 655 | GGTGCTTCTCCGGGCACCAGCTCTACT GGTTCTCCAGGTTCTAGCCCTTCTGCAT CCACCGGTACCGGTCCAGGTAGCTCTA CCCCTTCTGGTGCAACCGGCTCTCCAG GTACTTCTGAAAGCGCTACCCCGGAAT CTGGCCCAGGTAGCGAACCGGCTACTT | 688 | GASPGTSSTGSPGSSPSAST GTGPGSSTPSGATGSPGTS ESATPESGPGSEPATSGSET PGSEPATSGSETPGTSESAT PESGPGTSTEPSEGSAPGTS TEPSEGSAPGTSTEPSEGSA |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | CTGGTTCTGAAACCCCAGGTAGCGAAC CGGCTACCTCCGGTTCTGAAACTCCAG GTACTTCTGAAAGCGCTACTCCGGAGT CCGGTCCAGGTACCTCTACCGAACCGT CCGAAGGCAGCGCTCCAGGTACTTCTA CTGAACCTTCTGAGGGTAGCGCTCCAG GTACCTCTACCGAACCGTCCGAGGGTA GCGCACCAGGTACCTCTACTGAACCGT CTGAGGGTAGCGCTCCAGGTAGCGAAC CGGCAACCTCCGGTTCTGAAACTCCA | | PGTSTEPSEGSAPGSEPATS GSETP |
| LCW462_r16 | 656 | GGTACCTCTACCGAACCTTCCGAAGGT AGCGCTCCAGGTAGCCCGGCAGGTTCT CCTACTTCCACTGAGGAAGGTACTTCT ACCGAACCTTCTGAGGGTAGCGCACCA GGTACCTCTGAAAGCGCAACTCCTGAG TCTGGCCCAGGTAGCGAACCTGCTACC TCCGGCTCTGAGACTCCAGGTACCTCT GAAAGCGCAACCCCGGAATCTGGTCCA GGTAGCCCGGCTGGCTCTCCTACCTCT ACTGAGGAAGGTACTTCTGAAAGCGCT ACTCCTGAGTCTGGTCCAGGTACCTCT ACTGAACCGTCCGAAGGTAGCGCTCCA GGTAGCGAACCTGCTACTTCTGGTTCT GAAACTCCAGGTACTTCTACCGAACCG TCCGAGGGTAGCGCTCCAGGTAGCGAA CCTGCTACTTCTGGTTCTGAAACTCCA | 689 | GTSTEPSEGSAPGSPAGSPT STEEGTSTEPSEGSAPGTSE SATPESGPGSEPATSGSETP GTSESATPESGPGSPAGSPT STEEGTSESATPESGPGTST EPSEGSAPGSEPATSGSETP GTSTEPSEGSAPGSEPATS GSETP |
| LCW462_r20 | 657 | GGTACTTCTACCGAACCGTCCGAAGGC AGCGCTCCAGGTACCTCTACTGAACCT TCCGAGGGCAGCGCTCCAGGTACCTCT ACCGAACCTTCTGAAGGTAGCGCACCA GGTACTTCTACCGAACCGTCCGAAGGC AGCGCTCCAGGTACCTCTACTGAACCT TCCGAGGGCAGCGCTCCAGGTACCTCT ACCGAACCTTCTGAAGGTAGCGCACCA GGTACTTCTACCGAACCTTCCGAGGGC AGCGCACCAGGTACTTCTGAAAGCGCT ACCCCTGAGTCCGGCCCAGGTACTTCT GAAAGCGCTACTCCTGAATCCGGTCCA GGTACTTCTACTGAACCTTCCGAAGGT AGCGCTCCAGGTAGCGAACCTGCTACT TCTGGTTCTGAAACCCCAGGTAGCCCG GCTGGCTCTCCGACCTCCACCGAGGAA | 690 | GTSTEPSEGSAPGTSTEPSE GSAPGTSTEPSEGSAPGTS TEPSEGSAPGTSTEPSEGSA PGTSTEPSEGSAPGTSTEPS EGSAPGTSESATPESGPGT SESATPESGPGTSTEPSEGS APGSEPATSGSETPGSPAG SPTSTEE |
| LCW462_r23 | 658 | GGTACTTCTACCGAACCGTCCGAGGGC AGCGCTCCAGGTACTTCTACTGAACCT TCTGAAGGCAGCGCTCCAGGTACTTCT ACTGAACCTTCCGAAGGTAGCGCACCA GGTTCTACCAGCGAATCCCCTTCTGGT ACTGCTCCAGGTTCTACCAGCGAATCC CCTTCTGGCACCGCACCAGGTACTTCT ACCCCTGAAAGCGGCTCCGCTTCTCCA GGTAGCGAACCTGCAACCTCTGGCTCT GAAACCCCAGGTACCTCTGAAAGCGCT ACTCCTGAATCTGGCCCAGGTACTTCT ACTGAACCGTCCGAGGGCAGCGCACC AGGTACTTCTACTGAACCGTCTGAAGG TAGCGCACCAGGTACTTCTGAAAGCGC AACCCCGGAATCCGGCCCAGGTACCTC TGAAAGCGCAACCCCGGAGTCCGGCCCA | 691 | GTSTEPSEGSAPGTSTEPSE GSAPGTSTEPSEGSAPGSTS ESPSGTAPGSTSESPSGTAP GTSTPESGSASPGSEPATSG SETPGTSESATPESGPGTST EPSEGSAPGTSTEPSEGSAP GTSESATPESGPGTSESATP ESGP |
| LCW462_r24 | 659 | GGTAGCTCTACCCCTTCTGGTGCTACC GGCTCTCCAGGTTCTAGCCCGTCTGCTT CTACCGGTACCGGTCCAGGTAGCTCTA CCCCTTCTGGTGCTACTGGTTCTCCAGG TAGCCCTGCTGGCTCTCCGACTTCTACT GAGGAAGGTAGCCCGGCTGGTTCTCCG ACTTCTACTGAGGAAGGTACTTCTACC GAACCTTCCGAAGGTAGCGCTCCAGGT GCTTCCCCGGGCACTAGCTCTACCGGT TCTCCAGGTTCTAGCCCTTCTGCATCTA CTGGTACTGGCCCAGGTACTCCGGGCA GCGGTACTGCTTCTTCCTCTCCAGGTTC TACTAGCTCTACTGCTGAATCTCCTGG | 692 | GSSTPSGATGSPGSSPSAST GTGPGSSTPSGATGSPGSP AGSPTSTEEGSPAGSPTSTE EGTSTEPSEGSAPGASPGT SSTGSPGSSPSASTGTGPGT PGSGTASSSPGSTSSTAESP GPGTSPSGESSTAPGTSTPE SGSASP |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | CCCAGGTACTTCTCCTAGCGGTGAATC<br>TTCTACCGCTCCAGGTACCTCTACTCCG<br>GAAAGCGGTTCTGCATCTCCA | | |
| LCW462_r27 | 660 | GGTACCTCTACTGAACCTTCTGAGGGC<br>AGCGCTCCAGGTACTTCTGAAAGCGCT<br>ACCCCGGAGTCCGGTCCAGGTACTTCT<br>ACTGAACCGTCCGAAGGTAGCGCACCA<br>GGTACTTCTACTGAACCGTCTGAAGGT<br>AGCGCACCAGGTACTTCTGAAAGCGCA<br>ACCCCGGAATCCGGCCCAGGTACCTCT<br>GAAAGCGCAACCCCGGAGTCCGGCCC<br>AGGTACTCCTGGCAGCGGTACCGCTTC<br>TTCTTCTCCAGGTGCTTCTCCTGGTACT<br>AGCTCTACTGGTTCTCCAGGTGCTTCTC<br>CGGGCACTAGCTCTACTGGTTCTCCAG<br>GTAGCCCTGCTGGCTCTCCGACTTCTA<br>CTGAGGAAGGTAGCCCGGCTGGTTCTC<br>CGACTTCTACTGAGGAAGGTACTTCTA<br>CCGAACCTTCCGAAGGTAGCGCTCCA | 693 | GTSTEPSEGSAPGTSESATP<br>ESGPGTSTEPSEGSAPGTST<br>EPSEGSAPGTSESATPESGP<br>GTSESATPESGPGTPGSGT<br>ASSSPGASPGTSSTGSPGAS<br>PGTSSTGSPGSPAGSPTSTE<br>EGSPAGSPTSTEEGTSTEPS<br>EGSAP |
| LCW462_r28 | 661 | GGTAGCCCAGCAGGCTCTCCGACTTCC<br>ACTGAGGAAGGTACTTCTACTGAACCT<br>TCCGAAGGCAGCGCACCAGGTACCTCT<br>ACTGAACCTTCTGAGGGCAGCGCTCCA<br>GGTACCTCTACCGAACCGTCTGAAGGT<br>AGCGCACCAGGTACCTCTGAAAGCGCA<br>ACTCCTGAGTCCGGTCCAGGTACTTCT<br>GAAAGCGCAACCCCGGAGTCTGGCCC<br>AGGTACCCGGGTAGCGGTACTGCTTC<br>TTCCTCTCCAGGTAGCTCTACCCCTTCT<br>GGTGCAACCGGCTCTCCAGGTGCTTCT<br>CCGGGCACCAGCTCTACCGGTTCTCCA<br>GGTACCTCTACTGAACCTTCTGAGGGC<br>AGCGCTCCAGGTACTTCTGAAAGCGCT<br>ACCCCGGAGTCCGGTCCAGGTACTTCT<br>ACTGAACCGTCCGAAGGTAGCGCACCA | 694 | GSPAGSPTSTEEGTSTEPSE<br>GSAPGTSTEPSEGSAPGTS<br>TEPSEGSAPGTSESATPESG<br>PGTSESATPESGPGTPGSG<br>TASSSPGSSTPSGATGSPG<br>ASPGTSSTGSPGTSTEPSEG<br>SAPGTSESATPESGPGTSTE<br>PSEGSAP |
| LCW462_r38 | 662 | GGTAGCGAACCGGCAACCTCCGGCTCT<br>GAAACTCCAGGTACTTCTGAAAGCGCT<br>ACTCCGGAATCCGGCCCAGGTAGCGAA<br>CCGGCTACTTCCGGCTCTGAAACCCCA<br>GGTAGCTCTACCCCGTCTGGTGCAACC<br>GGCTCCCCAGGTACTCCTGGTAGCGGT<br>ACCGCTTCTTCTTCTCCAGGTAGCTCTA<br>CTCCGTCTGGTGCTACCGGCTCCCCAG<br>GTGCATCTCCTGGTACCAGCTCTACCG<br>GTTCTCCAGGTAGCTCTACTCCTTCTGG<br>TGCTACTGGCTCTCCAGGTGCTTCCCC<br>GGGTACCAGCTCTACCGGTTCTCCAGG<br>TAGCGAACCTGCTACTTCTGGTTCTGA<br>AACTCCAGGTACTTCTACCGAACCGTC<br>CGAGGGTAGCGCTCCAGGTAGCGAAC<br>CTGCTACTTCTGGTTCTGAAACTCCA | 695 | GSEPATSGSETPGTSESATP<br>ESGPGSEPATSGSETPGSST<br>PSGATGSPGTPGSGTASSS<br>PGSSTPSGATGSPGASPGT<br>SSTGPGSSTPSGATGSPG<br>ASPGTSSTGSPGSEPATSGS<br>ETPGTSTEPSEGSAPGSEPA<br>TSGSETP |
| LCW462_r39 | 663 | GGTACCTCTACTGAACCTTCCGAAGGC<br>AGCGCTCCAGGTACCTCTACCGAACCG<br>TCCGAGGGCAGCGCACCAGGTACTTCT<br>GAAAGCGCAACCCCTGAATCCGGTCCA<br>GGTAGCCCTGCTGGCTCTCCGACTTCT<br>ACTGAGGAAGGTAGCCCGGCTGGTTCT<br>CCGACTTCTACTGAGGAAGGTACTTCT<br>ACCGAACCTTCCGAAGGTAGCGCTCCA<br>GGTAGCCCGGCTGGTTCTCCGACTTCC<br>ACCGAGGAAGGTACCTCTACTGAACCT<br>TCTGAGGGTAGCGCTCCAGGTACCTCT<br>ACTGAACCTTCCGAAGGCAGCGCTCCA<br>GGTGCTTCCCCGGGCACCAGCTCTACT<br>GGTTCTCCAGGTTCTAGCCCGTCTGCTT<br>CTACTGGTACTGGTCCAGGTTCTAGCC<br>CTTCTGCTTCCACTGGTACTGGTCCA | 696 | GTSTEPSEGSAPGTSTEPSE<br>GSAPGTSESATPESGPGSP<br>AGSPTSTEEGSPAGSPTSTE<br>EGTSTEPSEGSAPGSPAGSP<br>TSTEEGTSTEPSEGSAPGTS<br>TEPSEGSAPGASPGTSSTGS<br>PGSSPSASTGTGPGSSPSAS<br>TGTGP |
| LCW462_r41 | 664 | GGTAGCTCTACCCCGTCTGGTGCTACC<br>GGTTCCCCAGGTGCTTCTCCTGGTACT<br>AGCTCTACCGGTTCTCCAGGTAGCTCT | 697 | GSSTPSGATGSPGASPGTS<br>STGSPGSSTPSGATGSPGSP<br>AGSPTSTEEGTSESATPESG |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | ACCCCGTCTGGTGCTACTGGCTCTCCA GGTAGCCCTGCTGGCTCTCCAACCTCC ACCGAAGAAGGTACCTCTGAAAGCGC AACCCCTGAATCCGGCCCAGGTAGCGA ACCGGCAACCTCCGGTTCTGAAACCCC AGGTGCATCTCCTGGTACTAGCTCTAC TGGTTCTCCAGGTAGCTCTACTCCGTCT GGTGCAACCGGCTCTCCAGGTTCTAGC CCTTCTGCATCTACCGGTACTGGTCCA GGTTCTACCAGCGAATCCCCTTCTGGT ACTGCTCCAGGTTCTACCAGCGAATCC CCTTCTGGCACCGCACCAGGTACTTCT ACCCCTGAAAGCGGCTCCGCTTCTCCA | | PGSEPATSGSETPGASPGTS STGSPGSSTPSGATGSPGSS PSASTGTGPGSTSESPSGTA PGSTSESPSGTAPGTSTPES GSASP |
| LCW462_r42 | 665 | GGTTCTACCAGCGAATCTCCTTCTGGC ACCGCTCCAGGTTCTACTAGCGAATCC CCGTCTGGTACCGCACCAGGTACTTCT CCTAGCGGCGAATCTTCTACCGCACCA GGTACCTCTGAAAGCGCTACTCCGGAG TCTGGCCCAGGTACCTCTACTGAACCG TCTGAGGGTAGCGCTCCAGGTACTTCT ACTGAACCGTCCGAAGGTAGCGCACCA GGTACCTCTACTGAACCTTCTGAGGGC AGCGCTCCAGGTACTTCTGAAAGCGCT ACCCCGGAGTCCGGTCCAGGTACTTCT ACTGAACCGTCCGAAGGTAGCGCACCA GGTAGCTCTACCCCGTCTGGTGCTACC GGTTCCCCAGGTGCTTCTCCTGGTACT AGCTCTACCGGTTCTCCAGGTAGCTCT ACCCCGTCTGGTGCTACTGGCTCTCCA | 698 | GSTSESPSGTAPGSTSESPS GTAPGTSPSGESSTAPGTS ESATPESGPGTSTEPSEGSA PGTSTEPSEGSAPGTSTEPS EGSAPGTSESATPESGPGT STEPSEGSAPGSSTPSGATG SPGASPGTSSTGSPGSSTPS GATGSP |
| LCW462_r43 | 666 | GGTTCTACTAGCTCTACTGCAGAATCT CCGGGCCCAGGTACCTCTCCTAGCGGT GAATCTTCTACCGCTCCAGGTACTTCTC CGAGCGGTGAATCTTCTACCGCTCCAG GTTCTACTAGCTCTACCGCTGAATCTCC GGGTCCAGGTTCTACCAGCTCTACTGC AGAATCTCCTGGCCCAGGTACTTCTAC TCCGGAAAGCGGTTCCGCTTCTCCAGG TACTTCTCCTAGCGGTGAATCTTCTACC GCTCCAGGTTCTACCAGCTCTACTGCT GAATCTCCTGGCCCAGGTACTTCTACC CCGGAAAGCGGCTCCGCTTCTCCAGGT TCTACCAGCTCTACCGCTGAATCTCCT GGCCCAGGTTCTACTAGCGAATCTCCG TCTGGCACCGCACCAGGTACTTCCCCT AGCGGTGAATCTTCTACTGCACCA | 699 | GSTSSTAESPGPGTSPSGES STAPGTSPSGESSTAPGSTS STAESPGPGTSSTAESPGP GTSTPESGSASPGTSPSGES STAPGSTSSTAESPGPGTST PESGSASPGTSSTAESPGP GSTSESPSGTAPGTSPSGES STAP |
| LCW462_r45 | 667 | GGTACCTCTACTCCGGAAAGCGGTTCC GCATCTCCAGGTTCTACCAGCGAATCC CCGTCTGGCACCGCACCAGGTTCTACT AGCTCTACTGCTGAATCTCCGGGCCCA GGTACCTCTACTGAACCTTCCGAAGGC AGCGCTCCAGGTACCTCTACCGAACCG TCCGAGGGCAGCGCACCAGGTACTTCT GAAAGCGCAACCCCTGAATCCGGTCCA GGTACCTCTGAAAGCGCTACTCCGGAG TCTGGCCCAGGTACCTCTACTGAACCG TCTGAGGGTAGCGCTCCAGGTACTTCT ACTGAACCGTCCGAAGGTAGCGCACCA GGTACTTCTGAAAGCGCTACTCCGGAG TCCGGTCCAGGTACCTCTACCGAACCG TCCGAAGGCAGCGCTCCAGGTACTTCT ACTGAACCTTCTGAGGGTAGCGCTCCC | 700 | GTSTPESGSASPGSTSESPS GTAPGSTSSTAESPGPGTS TEPSEGSAPGTSTEPSEGSA PGTSESATPESGPGTSESAT PESGPGTSTEPSEGSAPGTS TEPSEGSAPGTSESATPESG PGTSTEPSEGSAPGTSTEPS EGSAP |
| LCW462_r47 | 668 | GGTACCTCTACCGAACCGTCCGAGGGT AGCGCACCAGGTACCTCTACTGAACCG TCTGAGGGTAGCGCTCCAGGTAGCGAA CCGGCAACCTCCGGTTCTGAAACTCCA GGTACTTCTACTGAACCGTCTGAAGGT AGCGCACCAGGTACTTCTGAAAGCGCA ACCCCGGAATCCGGCCCAGGTACCTCT GAAAGCGCAACCCCGGAGTCCGGCCC AGGTGCATCTCCGGGTACTAGCTCTAC CGGTTCTCCAGGTTCTAGCCCCTTCTGCT | 701 | GTSTEPSEGSAPGTSTEPSE GSAPGSEPATSGSETPGTS TEPSEGSAPGTSESATPESG PGTSESATPESGPGASPGTS STGSPGSSPSASTGTGPGSS TPSGATGSPGSSTPSGATG SPGSSTPSGATGSPGASPG TSSTGSP |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | TCCACTGGTACCGGCCCAGGTAGCTCT ACCCCGTCTGGTGCTACTGGTTCCCCA GGTAGCTCTACTCCGTCTGGTGCAACC GGTTCCCCAGGTAGCTCTACTCCTTCTG GTGCTACTGGCTCCCCAGGTGCATCCC CTGGCACCAGCTCTACCGGTTCTCCA | | |
| LCW462_r54 | 669 | GGTAGCGAACCGGCAACCTCTGGCTCT GAAACTCCAGGTAGCGAACCTGCAACC TCCGGCTCTGAAACCCCAGGTACTTCT ACTGAACCTTCTGAGGGCAGCGCACCA GGTAGCGAACCTGCAACCTCTGGCTCT GAAACCCCAGGTACCTCTGAAAGCGCT ACTCCTGAATCTGGCCCAGGTACTTCT ACTGAACCGTCCGAGGGCAGCGCACC AGGTAGCTCTACTCCGTCTGGTGCTAC CGGCTCTCCAGGTAGCTCTACCCCTTCT GGTGCAACCGGCTCCCCAGGTGCTTCT CCGGGTACCAGCTCTACTGGTTCTCCA GGTAGCTCTACCCCGTCTGGTGCTACC GGTTCCCCAGGTGCTTCTCCTGGTACT AGCTCTACCGGTTCTCCAGGTAGCTCT ACCCCGTCTGGTGCTACTGGCTCTCCA | 702 | GSEPATSGSETPGSEPATS GSETPGTSTEPSEGSAPGSE PATSGSETPGTSESATPESG PGTSTEPSEGSAPGSSTPSG ATGSPGSSTPSGATGSPGA SPGTSSTGSPGSSTPSGATG SPGASPGTSSTGSPGSSTPS GATGSP |
| LCW462_r55 | 670 | GGTACTTCTACCGAACCGTCCGAGGGC AGCGCTCCAGGTACTTCTACTGAACCT TCTGAAGGCAGCGCTCCAGGTACTTCT ACTGAACCTTCCGAAGGTAGCGCACCA GGTACTTCTGAAAGCGCTACTCCGGAG TCCGGTCCAGGTACCTCTACCGAACCG TCCGAAGGCAGCGCTCCAGGTACTTCT ACTGAACCTTCTGAGGGTAGCGCTCCA GGTTCTACTAGCGAATCTCCGTCTGGC ACTGCTCCAGGTACTTCTCCTAGCGGT GAATCTTCTACCGCTCCAGGTACTTCC CCTAGCGGCGAATCTTCTACCGCTCCA GGTAGCCCGGCTGGCTCTCCTACCTCT ACTGAGGAAGGTACTTCTGAAAGCGCT ACTCCTGAGTCTGGTCCAGGTACCTCT ACTGAACCGTCCGAAGGTAGCGCTCCA | 703 | GTSTEPSEGSAPGTSTEPSE GSAPGTSTEPSEGSAPGTS ESATPESGPGTSTEPSEGSA PGTSTEPSEGSAPGSTSESP SGTAPGTSPSGESSTAPGTS PSGESSTAPGSPAGSPTSTE EGTSESATPESGPGTSTEPS EGSAP |
| LCW462_r57 | 671 | GGTACTTCTACTGAACCTTCCGAAGGT AGCGCTCCAGGTAGCGAACCTGCTACT TCTGGTTCTGAAACCCCAGGTAGCCCG GCTGGCTCTCCGACCTCCACCGAGGAA GGTAGCCCGGCAGGCTCTCCGACCTCT ACTGAGGAAGGTACTTCTGAAAGCGCA ACCCCGGAGTCCGGCCCAGGTACCTCT ACCGAACCGTCTGAGGGCAGCGCACC AGGTACCTCTACTGAACCTTCCGAAGG CAGCGCTCCAGGTACCTCTACCGAACC GTCCGAGGGCAGCGCACCAGGTACTTC TGAAAGCGCAACCCCTGAATCCGGTCC AGGTAGCTCTACTCCGTCTGGTGCAAC CGGCTCCCCAGGTTCTAGCCCGTCTGC TTCCACTGGTACTGGCCCAGGTGCTTC CCCGGGCACCAGCTCTACTGGTTCTCCA | 704 | GTSTEPSEGSAPGSEPATS GSETPGSPAGSPTSTEEGSP AGSPTSTEEGTSESATPESG PGTSTEPSEGSAPGTSTEPS EGSAPGTSTEPSEGSAPGT SESATPESGPGSSTPSGATG SPGSSPSASTGTGPGASPG TSSTGSP |
| LCW462_r61 | 672 | GGTAGCGAACCGGCTACTTCCGGCTCT GAGACTCCAGGTAGCCCTGCTGGCTCT CCGACCTCTACCGAAGAAGGTACCTCT GAAAGCGCTACCCCTGAGTCTGGCCCA GGTACCTCTACTGAACCTTCCGAAGGC AGCGCTCCAGGTACCTCTACCGAACCG TCCGAGGGCAGCGCACCAGGTACTTCT GAAAGCGCAACCCCTGAATCGGTCCA GGTACCTCTACTCCGAAAGCGGTTCC GCATCTCCAGGTTCTACCAGCGAATCC CCGTCTGGCACCGCACCAGGTTCTACT AGCTCTACTGCTGAATCTCCGGGCCCA GGTACTTCTGAAAGCGCTACTCCGGAG TCCGGTCCAGGTACCTCTACCGAACCG TCCGAAGGCAGCGCTCCAGGTACTTCT ACTGAACCTTCTGAGGGTAGCGCTCCA | 705 | GSEPATSGSETPGSPAGSPT STEEGTSESATPESGPGTST EPSEGSAPGTSTEPSEGSAP GTSESATPESGPGTSTPESG SASPGSTSESPSGTAPGSTS STAESPGPGTSESATPESGP GTSTEPSEGSAPGTSTEPSE GSAP |

TABLE 16-continued

DNA and amino acid sequences for AM144 segments

| Clone | SEQ ID NO: | Sequence Trimmed | SEQ ID NO: | Protein Sequence |
|---|---|---|---|---|
| LCW462_r64 | 673 | GGTACTTCTACCGAACCGTCCGAGGGC AGCGCTCCAGGTACTTCTACTGAACCT TCTGAAGGCAGCGCTCCAGGTACTTCT ACTGAACCTTCCGAAGGTAGCGCACCA GGTACCTCTACCGAACCGTCTGAAGGT AGCGCACCAGGTACCTCTGAAAGCGCA ACTCCTGAGTCCGGTCCAGGTACTTCT GAAAGCGCAACCCCGGAGTCTGGCCC AGGTACTCCTGGCAGCGGTACCGCATC TTCCTCTCCAGGTAGCTCTACTCCGTCT GGTGCAACTGGTTCCCCAGGTGCTTCT CCGGGTACCAGCTCTACCGGTTCTCCA GGTTCCACCAGCTCTACTGCTGAATCT CCTGGTCCAGGTACCTCTCCTAGCGGT GAATCTTCTACTGCTCCAGGTACTTCTA CTCCTGAAAGCGGCTCTGCTTCTCCA | 706 | GTSTEPSEGSAPGTSTEPSE GSAPGTSTEPSEGSAPGTS TEPSEGSAPGTSESATPESG PGTSESATPESGPGTPGSG TASSSPGSSTPSGATGSPG ASPGTSSTGSPGSTSSTAES PGPGTSPSGESSTAPGTSTP ESGSASP |
| LCW462_r67 | 674 | GGTAGCCCGGCAGGCTCTCCGACCTCT ACTGAGGAAGGTACTTCTGAAAGCGCA ACCCCGGAGTCCGGCCCAGGTACCTCT ACCGAACCGTCTGAGGGCAGCGCACC AGGTACTTCTGAAAGCGCAACCCCTGA ATCCGGTCCAGGTAGCGAACCGGCTAC TTCTGGCTCTGAGACTCCAGGTACTTCT ACCGAACCGTCCGAAGGTAGCGCACC AGGTAGCCCGGCTGGTTCTCCGACTTC CACCGAGGAAGGTACCTCTACTGAACC TTCTGAGGGTAGCGCTCCAGGTACCTC TACTGAACCTTCCGAAGGCAGCGCTCC AGGTACTTCTACCGAACCGTCCGAGGG CAGCGCTCCAGGTACTTCTACTGAACC TTCTGAAGGCAGCGCTCCAGGTACTTC TACTGAACCTTCCGAAGGTAGCGCACCA | 707 | GSPAGSPTSTEEGTSESATP ESGPGTSTEPSEGSAPGTSE SATPESGPGSEPATSGSETP GTSTEPSEGSAPGSPAGSPT STEEGTSTEPSEGSAPGTST EPSEGSAPGTSTEPSEGSAP GTSTEPSEGSAPGTSTEPSE GSAP |
| LCW462_r69 | 675 | GGTACTTCTCCGAGCGGTGAATCTTCT ACCGCACCAGGTTCTACTAGCTCTACC GCTGAATCTCCGGCCCAGGTACTTCT CCGAGCGGTGAATCTTCTACTGCTCCA GGTACCTCTGAAAGCGCTACTCCGGAG TCTGGCCCAGGTACCTCTACTGAACCG TCTGAGGGTAGCGCTCCAGGTACTTCT ACTGAACCGTCCGAAGGTAGCGCACCA GGTTCTAGCCCTTCTGCATCTACTGGTA CTGGCCCAGGTAGCTCTACTCCTTCTG GTGCTACCGGCTCTCCAGGTGCTTCTC CGGGTACTAGCTCTACCGGTTCTCCAG GTACTTCTACTCCGGAAAGCGGTTCCG CATCTCCAGGTACTTCTCCTAGCGGTG AATCTTCTACTGCTCCAGGTACCTCTCC TAGCGGCGAATCTTCTACTGCTCCA | 708 | GTSPSGESSTAPGSTSSTAE SPGPGTSPSGESSTAPGTSE SATPESGPGTSTEPSEGSAP GTSTEPSEGSAPGSSPSAST GTGPGSSTPSGATGSPGAS PGTSSTGSPGTSTPESGSAS PGTSPSGESSTAPGTSPSGE SSTAP |
| LCW462_r70 | 676 | GGTACCTCTGAAAGCGCTACTCCGGAG TCTGGCCCAGGTACCTCTACTGAACCG TCTGAGGGTAGCGCTCCAGGTACTTCT ACTGAACCGTCCGAAGGTAGCGCACCA GGTAGCCCTGCTGGCTCTCCGACTTCT ACTGAGGAAGGTAGCCCGGCTGGTTCT CCGACTTCTACTGAGGAAGGTACTTCT ACCGAACCTTCCGAAGGTAGCGCTCCA GGTTCTAGCCCTTCTGCTTCCACCGGTA CTGGCCCAGGTAGCTCTACCCCTTCTG GTGCTACCGGCTCCCCAGGTAGCTCTA CTCCTTCTGGTGCAACTGGCTCTCCAG GTAGCGAACCGGCAACTTCCGGCTCTG AAACCCCAGGTACTTCTGAAAGCGCTA CTCCTGAGTCTGGCCCAGGTAGCGAAC CTGCTACCTCTGGCTCTGAAACCCCA | 709 | GTSESATPESGPGTSTEPSE GSAPGTSTEPSEGSAPGSP AGSPTSTEEGSPAGSPTSTE EGTSTEPSEGSAPGSSPSAS TGTGPGSSTPSGATGSPGS STPSGATGSPGSEPATSGSE TPGTSESATPESGPGSEPAT SGSETP |
| LCW462_r72 | 677 | GGTACTTCTACCGAACCGTCCGAAGGC AGCGCTCCAGGTACCTCTACTGAACCT TCCGAGGGCAGCGCTCCAGGTACCTCT ACCGAACCTTCTGAAGGTAGCGCACCA GGTAGCTCTACCCCGTCTGGTGCTACC GGTTCCCCAGGTGCTTCTCCTGGTACT | 710 | GTSTEPSEGSAPGTSTEPSE GSAPGTSTEPSEGSAPGSST PSGATGSPGASPGTSSTGS PGSSTPSGATGSPGTSESAT PESGPGSEPATSGSETPGTS TEPSEGSAPGSTSESPSGTA |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | AGCTCTACCGGTTCTCCAGGTAGCTCT ACCCCGTCTGGTGCTACTGGCTCTCCA GGTACTTCTGAAAGCGCAACCCCTGAA TCCGGTCCAGGTAGCGAACCGGCTACT TCTGGCTCTGAGACTCCAGGTACTTCT ACCGAACCGTCCGAAGGTAGCGCACC AGGTTCTACTAGCGAATCTCCTTCTGG CACTGCACCAGGTTCTACCAGCGAATC TCCGTCTGGCACTGCACCAGGTACCTC TACCCCTGAAAGCGGTTCCGCTTCTCCA | | PGSTSESPSGTAPGTSTPES GSASP |
| LCW462_r73 | 678 | GGTACCTCTACTCCTGAAAGCGGTTCT GCATCTCCAGGTTCCACTAGCTCTACC GCAGAATCTCCGGGCCCAGGTTCTACT AGCTCTACTGCTGAATCTCCTGGCCCA GGTTCTAGCCCCTTCTGCATCTACTGGTA CTGGCCCAGGTAGCTCTACTCCTTCTG GTGCTACCGGCTCTCCAGGTGCTTCTC CGGGTACTAGCTCTACCGGTTCTCCAG GTAGCGAACCGGCAACCTCCGGCTCTG AAACCCCAGGTACCTCTGAAAGCGCTA CTCCTGAATCCGGCCCAGGTAGCCCGG CAGGTTCTCCGACTTCCACTGAGGAAG GTTCTACTAGCGAATCTCCTTCTGGCA CTGCACCAGGTTCTACCAGCGAATCTC CGTCTGGCACTGCACCAGGTACCTCTA CCCCTGAAAGCGGTTCCGCTTCTCCC | 711 | GTSTPESGSASPGSTSSTAE SPGPGSTSSTAESPGPGSSP SASTGTGPGSSTPSGATGS PGASPGTSSTGSPGSEPATS GSETPGTSESATPESGPGSP AGSPTSTEEGSTSESPSGTA PGSTSESPSGTAPGTSTPES GSASP |
| LCW462_r78 | 679 | GGTAGCCCGGCTGGCTCTCCTACCTCT ACTGAGGAAGGTACTTCTGAAAGCGCT ACTCCTGAGTCTGGTCCAGGTACCTCT ACTGAACCGTCCGAAGGTAGCGCTCCA GGTTCTACCAGCGAATCTCCTTCTGGC ACCGCTCCAGGTTCTACTAGCGAATCC CCGTCTGGTACCGCACCAGGTACTTCT CCTAGCGGCGAATCTTCTACCGCACCA GGTACCTCTACCGAACCTTCCGAAGGT AGCGCTCCAGGTAGCCCGGCAGGTTCT CCTACTTCCACTGAGGAAGGTACTTCT ACCGAACCTTCTGAGGGTAGCGCACCA GGTAGCGAACCTGCAACCTCTGGCTCT GAAACCCCAGGTACCTCTGAAAGCGCT ACTCCTGAATCTGGCCCAGGTACTTCT ACTGAACCGTCCGAGGGCAGCGCACCA | 712 | GSPAGSPTSTEEGTSESATP ESGPGTSTEPSEGSAPGSTS ESPSGTAPGSTSESPSGTAP GTSPSGESSTAPGTSTEPSE GSAPGSPAGSPTSTEEGTS TEPSEGSAPGSEPATSGSET PGTSESATPESGPGTSTEPS EGSAP |
| LCW462_r79 | 680 | GGTACCTCTACCGAACCTTCCGAAGGT AGCGCTCCAGGTAGCCCGGCAGGTTCT CCTACTTCCACTGAGGAAGGTACTTCT ACCGAACCTTCTGAGGGTAGCGCACCA GGTACCTCCCCTAGCGGCGAATCTTCT ACTGCTCCAGGTACCTCTCCTAGCGGC GAATCTTCTACCGCTCCAGGTACCTCC CCTAGCGGTGAATCTTCTACCGCACCA GGTTCTACCAGCGAATCCCCTTCTGGT ACTGCTCCAGGTTCTACCAGCGAATCC CCTTCTGGCACCGCACCAGGTACTTCT ACCCCTGAAAGCGGCTCCGCTTCTCCA GGTAGCGAACCTGCAACCTCTGGCTCT GAAACCCCAGGTACCTCTGAAAGCGCT ACTCCTGAATCTGGCCCAGGTACTTCT ACTGAACCGTCCGAGGGCAGCGCACCA | 713 | GTSTEPSEGSAPGSPAGSPT STEEGTSTEPSEGSAPGTSP SGESSTAPGTSPSGESSTAP GTSPSGESSTAPGTSESPS GTAPGSTSESPSGTAPGTS TPESGSASPGSEPATSGSET PGTSESATPESGPGTSTEPS EGSAP |
| LCW462_r87 | 681 | GGTAGCGAACCGGCAACCTCTGGCTCT GAAACCCCAGGTACCTCTGAAAGCGCT ACTCCGGAATCTGGTCCAGGTACTTCT GAAAGCGCTACTCCGGAATCCGGTCCA GGTACTTCTCCGAGCGGTGAATCTTCT ACCGCACCAGGTTCTACTAGCTCTACC GCTGAATCTCCGGGCCCAGGTACTTCT CCGAGCGGTGAATCTTCTACTGCTCCA GGTTCTACTAGCGAATCCCCGTCTGGT ACTGCTCCAGGTACTTCCCCTAGCGGT GAATCTTCTACTGCTCCAGGTTCTACC AGCTCTACCGCAGAATCTCCGGGTCCA GGTAGCTCTACTCCGTCTGGTGCAACC | 714 | GSEPATSGSETPGTSESATP ESGPGTSESATPESGPGTSP SGESSTAPGSTSSTAESPGP GTSPSGESSTAPGTSESPS GTAPGTSPSGESSTAPGSTS STAESPGPGSSTPSGATGSP GSSTPSGATGSPGSSTPSG ANWLS |

TABLE 16-continued

DNA and amino acid sequences for AM144 segments

| Clone | SEQ ID NO: | Sequence Trimmed | SEQ ID NO: | Protein Sequence |
|---|---|---|---|---|
| | | GGTTCCCCAGGTAGCTCTACCCCTTCT<br>GGTGCAACCGGCTCCCCAGGTAGCTCT<br>ACCCCTTCTGGTGCAAACTGGCTCTCC | | |
| LCW462_r88 | 682 | GGTAGCCCTGCTGGCTCTCCGACTTCT<br>ACTGAGGAAGGTAGCCCGGCTGGTTCT<br>CCGACTTCTACTGAGGAAGGTACTTCT<br>ACCGAACCTTCCGAAGGTAGCGCTCCA<br>GGTACCTCTACTGAACCTTCCGAAGGC<br>AGCGCTCCAGGTACCTCTACCGAACCG<br>TCCGAGGGCAGCGCACCAGGTACTTCT<br>GAAAGCGCAACCCCTGAATCCGGTCCA<br>GGTGCATCTCCTGGTACCAGCTCTACC<br>GGTTCTCCAGGTAGCTCTACTCCTTCTG<br>GTGCTACTGGCTCTCCAGGTGCTTCCC<br>CGGGTACCAGCTCTACCGGTTCTCCAG<br>GTAGCTCTACCCCGTCTGGTGCTACTG<br>GTTCTCCAGGTACTCCGGGCAGCGGTA<br>CTGCTTCTTCCTCTCCAGGTAGCTCTAC<br>CCCTTCTGGTGCTACTGGCTCTCCA | 715 | GSPAGSPTSTEEGSPAGSPT<br>STEEGTSTEPSEGSAPGTST<br>EPSEGSAPGTSTEPSEGSAP<br>GTSESATPESGPGASPGTSS<br>TGSPGSSTPSGATGSPGAS<br>PGTSSTGSPGSSTPSGATGS<br>PGTPGSGTASSSPGSSTPSG<br>ATGSP |
| LCW462_r89 | 683 | GGTAGCTCTACCCCGTCTGGTGCTACT<br>GGTTCTCCAGGTACTCCGGGCAGCGGT<br>ACTGCTTCTTCCTCTCCAGGTAGCTCTA<br>CCCCTTCTGGTGCTACTGGCTCTCCAG<br>GTAGCCCGGCTGGCTCTCCTACCTCTA<br>CTGAGGAAGGTACTTCTGAAAGCGCTA<br>CTCCTGAGTCTGGTCCAGGTACCTCTA<br>CTGAACCGTCCGAAGGTAGCGCTCCAG<br>GTACCTCTGAAAGCGCAACTCCTGAGT<br>CTGGCCCAGGTAGCGAACCTGCTACCT<br>CCGGCTCTGAGACTCCAGGTACCTCTG<br>AAAGCGCAACCCCGGAATCTGGTCCAG<br>GTACTTCTACTGAACCGTCTGAAGGTA<br>GCGCACCAGGTACTTCTGAAAGCGCAA<br>CCCCGGAATCCGGCCCAGGTACCTCTG<br>AAAGCGCAACCCCGGAGTCCGGCCCA | 716 | GSSTPSGATGSPGTPGSGT<br>ASSSPGSSTPSGATGSPGSP<br>AGSPTSTEEGTSESATPESG<br>PGTSTEPSEGSAPGTSESAT<br>PESGPGSEPATSGSETPGTS<br>ESATPESGPGTSTEPSEGSA<br>PGTSESATPESGPGTSESAT<br>PESGP |

Example 7

Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8

Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmid was isolated from cultures of E. coli harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening this library yielded 4 isolates that were selected for further construction.

Example 9

Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 717) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 718) for introducing the sequencing island A (SI-A) which encodes amino acids GASASGAPSTG (SEQ ID NO: 719) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in example 5. This new library of XTEN_AM875 segment was designated LCW0481.

Example 10

Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 720) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 721) for introducing the sequencing island B (SI-B) which encodes amino acids GPEPTGPAPSG (SEQ ID NO: 722) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in example 5. This new library of XTEN_AM1318 segment was designated LCW0487.

Example 11

Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12

Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full length clone of XTEN_AG864 had excellent solubility and showed half-life exceeding 60 h in cynomolgus monkeys.

Example 14

Construction of N-Terminal Extensions of XTEN-Construction and Screening of 12mer Addition Libraries This example details a step in the optimization of the N-terminus of the XTEN protein to promote the initiation of translation to allow for expression of XTEN fusions at the N-terminus of fusion proteins without the presence of a helper domain. To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of seven libraries. The resulting clones have N-terminal XTEN 12mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 17).

TABLE 17

Theoretical Diversity and Sampling Numbers for
12mer Addition Libraries.
The amino acid residues with randomized codons are underlined.

| Library | Motif Family | SEQ ID NO: | Amino Acid Sequence | Theoretical Diversity | Number screened |
|---|---|---|---|---|---|
| LCW546 | AE12 | 723 | MASPAGSPTSTEE | 572 | 2 plates (168) |
| LCW547 | AE12 | 724 | MATSESATPESGP | 1536 | 5 plates (420) |
| LCW548 | AF12 | 725 | MATSPSGESSTAP | 192 | 2 plates (168) |
| LCW549 | AF12 | 726 | MESTSSTAESPGP | 384 | 2 plates (168) |
| LCW552 | AG12 | 727 | MASSTPSGATGSP | 384 | 2 plates (168) |
| LCW553 | AG12 | 728 | MEASPGTSSTGSP | 384 | 2 plates (168) |
| LCW554 | (CBD-like) | 729 | MASTPESGSSG | 32 | 1 plate (84) |

The saturated overnight cultures were used to inoculate fresh 500 µl cultures in auto-induction media in which they were grown overnight at 26° C. These expression cultures were then assayed using a fluorescence plate reader (excitation 395 nm, emission 510 nm) to determine the amount of GFP reporter present. The results indicate that median expression levels are approximately half of the expression levels with the CBD N-terminal helper domain. However, the best clones from the libraries were much closer to the benchmarks and indicate that further optimization around those sequences was warranted. It also was clear that the libraries starting with amino acids MA produced better expression than those beginning with ME. This was most apparent when looking at the best clones, which were closer to the benchmarks as they mostly start with MA. Of the 176 clones within 33% of the CBD-AM875 benchmark, 87% begin with MA, whereas only 75% of the sequences in the libraries beginning with MA, a clear over representation of the clones beginning with MA at the highest level of expression. 96 of the best clones were sequenced to confirm identity and twelve sequences (see Table 18), 4 from LCW546, 4 from LCW547 and 4 from LCW552 were selected for further optimization.

TABLE 18

Advanced 12mer DNA Sequences

| Clone | SEQ ID NO: | DNA Sequence |
|---|---|---|
| LCW546_02 | 730 | ATGGCTAGTCCGGCTGGCTCTCCGACCTCCACTGAGGAAGGTACTTCTACT |
| LCW546_06 | 731 | ATGGCTAGTCCTGCTGGCTCTCCAACCTCCACTGAGGAAGGTACTTCTACT |
| LCW546_07 | 732 | ATGGCTAGTCCAGCAGGCTCTCCTACCTCCACCGAGGAAGGTACTTCTACT |
| LCW546_09 | 733 | ATGGCTAGTCCTGCTGGCTCTCCGACCTCTACTGAGGAAGGTACTTCTACT |
| LCW547_03 | 734 | ATGGCTACATCCGAAAGCGCAACCCCTGAGTCCGGTCCAGGTACTTCTACT |
| LCW547_06 | 735 | ATGGCTACATCCGAAAGCGCAACCCCTGAATCTGGTCCAGGTACTTCTACT |
| LCW547_10 | 736 | ATGGCTACGTCTGAAAGCGCTACTCCGGAATCTGGTCCAGGTACTTCTACT |
| LCW547_17 | 737 | ATGGCTACGTCCGAAAGCGCTACCCCTGAATCCGGTCCAGGTACTTCTACT |
| LCW552_03 | 738 | ATGGCTAGTTCTACCCCGTCTGGTGCAACCGGTTCCCCAGGTACTTCTACT |
| LCW552_05 | 739 | ATGGCTAGCTCCACTCCGTCTGGTGCTACCGGTTCCCCAGGTACTTCTACT |
| LCW552_10 | 740 | ATGGCTAGCTCTACTCCGTCTGGTGCTACTGGTTCCCCAGGTACTTCTACT |
| LCW552_11 | 741 | ATGGCTAGTTCTACCCCTTCTGGTGCTACTGGTTCTCCAGGTACTTCTACT |

Example 15

Construction of N-Terminal Extensions of XTEN-Construction and Screening of Libraries Optimizing Codons 3 and 4

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions. In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of three libraries LCW0569-571. With 24 XTEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples. 52 clones yielded usable sequencing data and were used for subsequent analysis. The results were broken down by library and indicate that LCW546 was the superior library. The results are presented in Table 19.

TABLE 19

Third and Fourth Codon Optimization Library Comparison

|  | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 20.

TABLE 20

Preferred Third and Fourth Codons in LCW569

|  | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Figure 11:
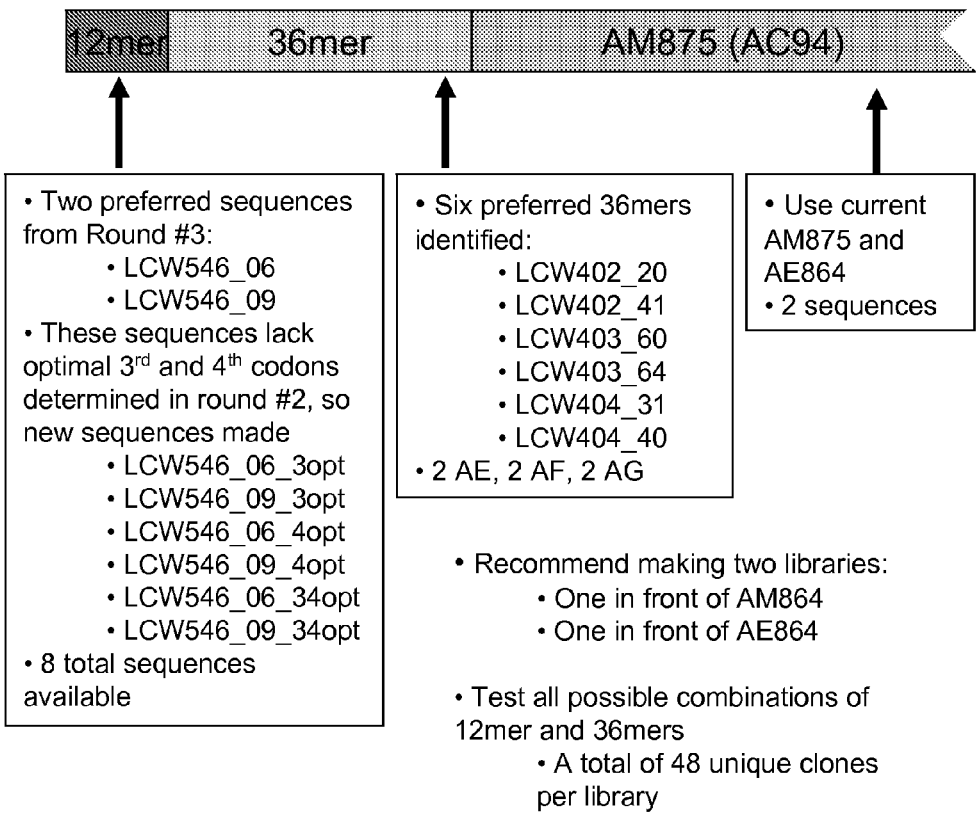
FIG. 11 is a schematic of a combinatorial approach undertaken for the union of codon optimization preferences for two regions of the N-terminus 48 amino acids. The approach created novel 48mers at the N-terminus of the XTEN protein for evaluation of the optimization of expression that resulted in leader sequences that may be a solution for expression of XTEN proteins where the XTEN is N-terminal to the BP.
Figure 12:
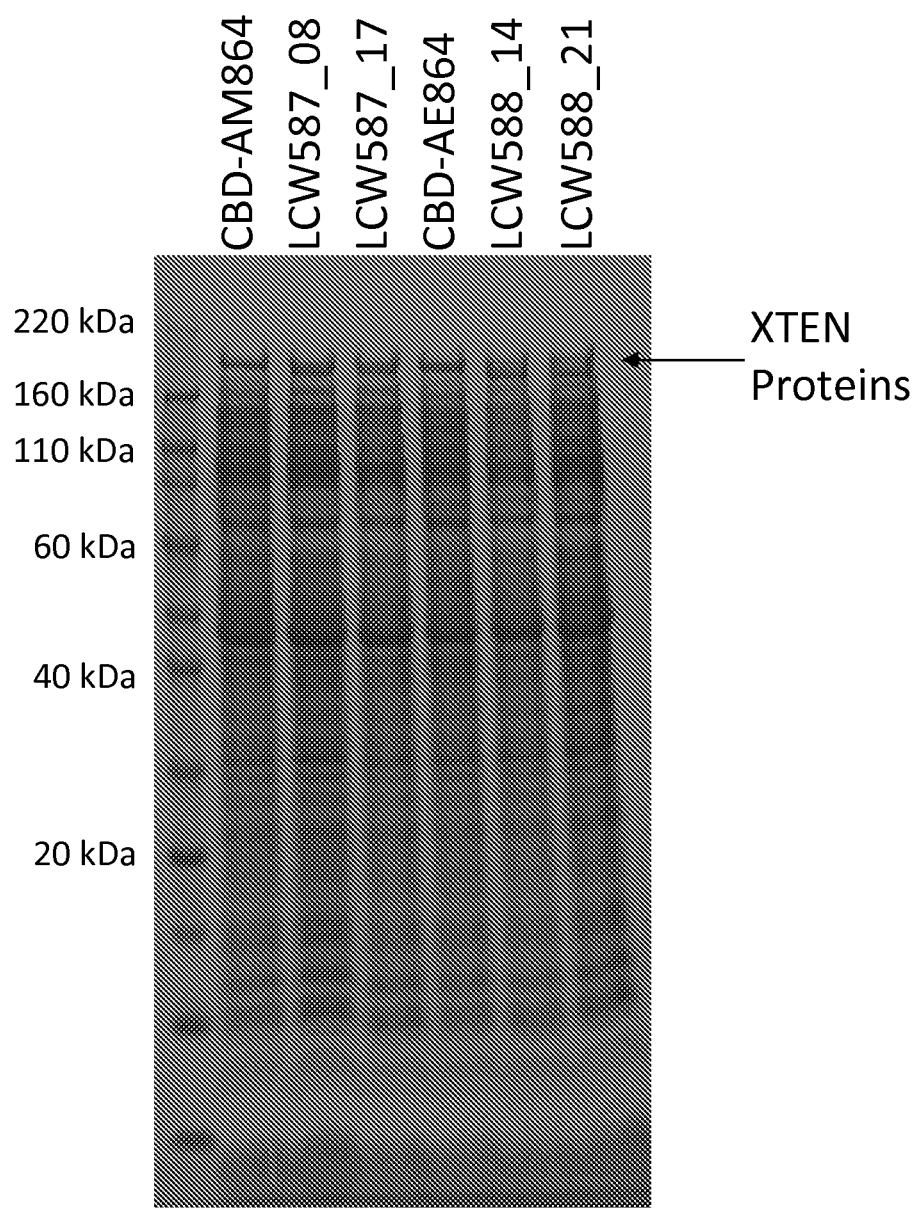
FIG. 12 shows an SDS-PAGE gel confirming expression of preferred clones obtained from the XTEN N-terminal codon optimization experiments, in comparison to benchmark XTEN clones comprising CBD leader sequences at the N-terminus of the construct sequences.

Construction of N-Terminal Extensions of XTEN-Construction and Screening of Combinatorial 12mer and 36mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12mer sequences (see Example supra) at the very N-terminus followed by 125 previously constructed 36mer segments (see example supra) in a combinatorial manner. This created novel 48mers at the N-terminus of the XTEN protein and enabled the assessment of the impact of longer range interactions at the N-terminus on expression of the longer sequences (FIG. 11). Similar to the dimerization procedures used to assemble 36mers (see Example infra), the plasmids containing the 125 selected 36mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into E. coli BL21Gold(DE3) competent cells to obtain colonies of the library LCW0579, which also served as the vector for further cloning 12 selected 12mers at the very N-terminus. The plasmids of LCW0579 were digested with NdeI/EcoRI/BsaI and the appropriate fragments were gel-purified. 12 pairs of oligonucleotides encoding 12 selected 12mer sequences were designed, annealed and ligated with the NdeI/EcoRI/BsaI digested LCW0579 vector, and transformed into E. coli BL21Gold (DE3) competent cells to obtain colonies of the library LCW0580. With a theoretical diversity of 1500 unique clones, a total of 1512 individual colonies from the created library were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12mer that was present in each clone and the impact of each 12mer on expression was assessed. Clones LCW546_06 and LCW546_09 stood out as being the superior N-terminus (see Table 21).

TABLE 21

Relative Performance of Clones Starting with LCW546_06 and LCW459_09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 22. It was noted that these were the only occurrences of these sequences and in no case did one of these sequences occur and fail to beat the bench-mark clone. These six sequences were advanced for further optimization.

TABLE 22

Combinatorial 12mer and 36mer Clones Superior to Benchmark Clone

| Clone Name | SEQ ID NO: | First 60 codons | 12mer Name | 36mer Name |
|---|---|---|---|---|
| LCW580_51 | 742 | ATGGCTAGTCCTGCTGGCTCTCCAACCTCCA CTGAGGAAGGTGCATCCCCGGGCACCAGCT CTACCGGTTCTCCAGGTAGCTCTACCCCGTC TGGTGCTACCGGCTCTCCAGGTAGCTCTACC CCGTCTGGTGCTACTGGCTCTCCAGGTACTT CTACTGAACCGTCTGAAGGCAGCGCA | LCW546_06 | LCW0404_040 |
| LCW580_81 | 743 | ATGGCTAGTCCTGCTGGCTCTCCAACCTCCA CTGAGGAAGGTGCATCCCCGGGCACCAGCT CTACCGGTTCTCCAGGTAGCTCTACCCCGTC TGGTGCTACCGGCTCTCCAGGTAGCTCTACC CCGTCTGGTGCTACTGGCTCTCCAGGTACTT CTACTGAACCGTCTGAAGGCAGCGCA | LCW546_06 | LCW0404_040 |
| LCW580_38 | 744 | ATGGCTAGTCCTGCTGGCTCTCCAACCTCCA CTGAGGAAGGTACTTCTACCGAACCGTCCG AGGGTAGCGCACCAGGTAGCCCAGCAGGTT CTCCTACCTCCACCGAGGAAGGTACTTCTAC CGAACCGTCCGAGGGTAGCGCACCAGGTAC TTCTACTGAACCGTCTGAAGGCAGCGCA | LCW546_06 | LCW0402_041 |
| LCW580_63 | 745 | ATGGCTAGTCCTGCTGGCTCTCCGACCTCTA CTGAGGAAGGTACTTCTACTGAACCGTCTG AAGGCAGCGCACCAGGTAGCGAACCGGCTA CTTCCGGTTCTGAAACCCCAGGTAGCCCAG CAGGTTCTCCAACTTCTACTGAAGAAGGTA CTTCTACTGAACCGTCTGAAGGCAGCGCA | LCW546_09 | LCW0402_020 |
| LCW580_06 | 746 | ATGGCTAGTCCTGCTGGCTCTCCAACCTCCA CTGAGGAAGGTACCCCGGGTAGCGGTACTG CTTCTTCCTCTCCAGGTAGCTCTACCCCTTC TGGTGCAACCGGCTCTCCAGGTGCTTCTCCG GGCACCAGCTCTACCGGTTCTCCAGGTACTT CTACTGAACCGTCTGAAGGCAGCGCA | LCW546_06 | LCW0404_031 |
| LCW580_35 | 747 | ATGGCTAGTCCTGCTGGCTCTCCGACCTCTA CTGAGGAAGGTACTTCTACTGAACCGTCTG AAGGCAGCGCACCAGGTAGCGAACCGGCTA CTTCCGGTTCTGAAACCCCAGGTAGCCCAG CAGGTTCTCCAACTTCTACTGAAGAAGGTA CTTCTACTGAACCGTCTGAAGGCAGCGCA | LCW546_09 | LCW0402_020 |
| LCW580_67 | 748 | ATGGCTAGTCCTGCTGGCTCTCCGACCTCTA CTGAGGAAGGTACCTCCCCTAGCGGCGAAT CTTCTACTGCTCCAGGTACCTCTCCTAGCGG CGAATCTTCTACCGCTCCAGGTACCTCCCCT AGCGGTGAATCTTCTACCGCACCAGGTACT TCTACTGAACCGTCTGAAGGCAGCGCA | LCW546_09 | LCW0403_064 |
| LCW580_13 | 749 | ATGGCTAGTCCTGCTGGCTCTCCGACCTCTA CTGAGGAAGGTACCTCTACTCCGGAAAGCG GTTCCGCATCTCCAGGTTCTACCAGCGAATC CCCGTCTGGCACCGCACCAGGTTCTACTAG CTCTACTGCTGAATCTCCGGGCCCAGGTACT TCTACTGAACCGTCTGAAGGCAGCGCA | LCW546_09 | LCW0403_060 |
| LCW580_88 | 750 | ATGGCTAGTCCTGCTGGCTCTCCGACCTCTA CTGAGGAAGGTACCTCCCCTAGCGGCGAAT CTTCTACTGCTCCAGGTACCTCTCCTAGCGG CGAATCTTCTACCGCTCCAGGTACCTCCCCT AGCGGTGAATCTTCTACCGCACCAGGTACT TCTACTGAACCGTCTGAAGGCAGCGCA | LCW546_09 | LCW0403_064 |
| LCW580_11 | 751 | ATGGCTAGTCCTGCTGGCTCTCCGACCTCTA CTGAGGAAGGTACCTCTACTCCGGAAAGCG GTTCCGCATCTCCAGGTTCTACCAGCGAATC CCCGTCTGGCACCGCACCAGGTTCTACTAG CTCTACTGCTGAATCTCCGGGCCCAGGTACT TCTACTGAACCGTCTGAAGGCAGCGCA | LCW546_09 | LCW0403_060 |

Example 17

Construction of N-Terminal Extensions of XTEN-Construction and Screening of Combinatorial 12mer and 36mer Libraries for XTEN-AM875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12mers and 36mers (see Example supra) established, a combinatorial approach was undertaken to examine the union of these preferences. This created novel 48mers at the N-terminus of the XTEN protein and enabled the testing of the confluence of previous conclusions. Additionally, the ability of these leader sequences to be a universal solution for all XTEN proteins was assessed by placing the new 48mers in front of both XTEN-AE864 and XTEN-AM875. Instead of using all 125 clones of 36mer segment, the plasmids from 6 selected clones of 36mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (—XTEN_AM875-GFP) and LCW0586 (—XTEN_AE864-GFP), which could also serve as the vectors for further cloning 8 selected 12mers at the very N-terminus. The plasmids of LCW0585 and LCW0586 were digested with NdeI/EcoRI/BsaI and the appropriate fragments were gel-purified. 8 pairs of oligonucleotides encoding 8 selected 12mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTEN_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12mer, the third codon, the fourth codon and the 36mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values than the benchmark controls (see Tables 23 and 24).

TABLE 23

Preferred N-terminal Combinations for XTEN-AM875

| Clone Name | Number of Replicates | 12mer | 36mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 24

Preferred N-terminal Combinations for XTEN-AE864

| Clone Name | Number of Replicates | 12mer | 36mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Notably, the preferred combination of the N-terminal for the XTEN-AM875 and the preferred combination for the XTEN-AE864 are not the same (Tables 23 and 24), indicating more complex interactions further than 150 bases from the initiation site influence expression levels. The sequences for the preferred nucleotide sequences are listed in Table 25 and the preferred clones were analyzed by SDS-PAGE to independently confirm expression. The complete sequences of XTEN_AM923 and XTEN_AE912 were selected for further analysis.

TABLE 25

Preferred DNA Sequences for first 48 Amino Acid Residues of
N-terminal XTEN-AM875 and XTEN-AE864

| Clone Name | XTEN Name | SEQ ID NO: | Nucleotide Sequence |
|---|---|---|---|
| LCW587_08 | AM875 | 752 | ATGGCTGAACCTGCTGGCTCTCCAACCTCCACTGAGGAAGGTGCA<br>TCCCCGGGCACCAGCTCTACCGGTTCTCCAGGTAGCTCTACCCCG<br>TCTGGTGCTACCGGCTCTCCAGGTAGCTCTACCCCGTCTGGTGCT<br>ACTGGCTCTCCAGGTACTTCTACTGAACCGTCTGAAGGCAGCGCA |
| LCW587_17 | AM875 | 753 | ATGGCTGAACCTGCTGGCTCTCCGACCTCTACTGAGGAAGGTACC<br>TCCCCTAGCGGCGAATCTTCTACTGCTCCAGGTACCTCTCCTAGC<br>GGCGAATCTTCTACCGCTCCAGGTACCTCCCCTAGCGGTGAATCT<br>TCTACCGCACCAGGTACTTCTACTGAACCGTCTGAAGGCAGCGCA |
| LCW588_14 | AE864 | 754 | ATGGCTGAACCTGCTGGCTCTCCAACCTCCACTGAGGAAGGTACC<br>CCGGGTAGCGGTACTGCTTCTTCCTCTCCAGGTAGCTCTACCCCTT<br>CTGGTGCAACCGGCTCTCCAGGTGCTTCTCCGGGCACCAGCTCTA<br>CCGGTTCTCCAGGTAGCCCGGCTGGCTCTCCTACCTCTACTGAG |
| LCW588_27 | AE864 | 755 | ATGGCTGAAACTGCTGGCTCTCCAACCTCCACTGAGGAAGGTGCA<br>TCCCCGGGCACCAGCTCTACCGGTTCTCCAGGTAGCTCTACCCCG<br>TCTGGTGCTACCGGCTCTCCAGGTAGCTCTACCCCGTCTGGTGCT<br>ACTGGCTCTCCAGGTAGCCCGGCTGGCTCTCCTACCTCTACTGAG |

Example 18

Methods of Producing and Evaluating BPXTEN; XTEN-Ex4 as Example

A general schema for producing and evaluating BPXTEN compositions is presented in FIG. 6, and forms the basis for the general description of this Example. Using the disclosed methods and those known to one of ordinary skill in the art, together with guidance provided in the illustrative examples, a skilled artesian can create and evaluate a range of BPXTEN fusion proteins comprising, XTENs, BP and variants of BP known in the art. The Example is, therefore, to be construed as merely illustrative, and not limitative of the methods in any way whatsoever; numerous variations will be apparent to the ordinarily skilled artisan. In this Example, a BPXTEN of exendin-4 ("Ex4") linked to an XTEN of the AE family of motifs would be created.

The general schema for producing polynucleotides encoding XTEN is presented in FIGS. 4 and 5. FIG. 5 is a schematic flowchart of representative steps in the assembly of a XTEN polynucleotide construct in one of the embodiments of the invention. Individual oligonucleotides 501 are annealed into sequence motifs 502 such as a 12 amino acid motif ("12-mer"), which is subsequently ligated with an oligo containing BbsI, and KpnI restriction sites 503. The motif libraries can be limited to specific sequence XTEN families; e.g., AD, AE, AF, AG, AM, or AQ sequences of Table 1. In this case, the motifs of the AE family (SEQ ID NOS: 186-189) would be used as the motif library, which are annealed to the 12-mer to create a "building block" length; e.g., a segment that encodes 36 amino acids. The gene encoding the XTEN sequence can be assembled by ligation and multimerization of the "building blocks" until the desired length of the XTEN gene 504 is achieved. As illustrated in FIG. 5, the XTEN length in this case is 48 amino acid residues, but longer lengths can be achieved by this process. For example, multimerization can be performed by ligation, overlap extension, PCR assembly or similar cloning techniques known in the art. The XTEN gene can be cloned into a stuffer vector. In the example illustrated in FIG. 5, the vector can encode a Flag sequence 506 followed by a stuffer sequence that is flanked by BsaI, BbsI, and KpnI sites 507 and a BP gene (e.g., exendin-4) 508, resulting in the gene encoding the BPXTEN 500, which, in this case encodes the fusion protein in the configuration, N- to C-terminus, XTEN-Ex4.

DNA sequences encoding Ex4 (or another candidate BP) can be conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. A gene or polynucleotide encoding the Ex4 portion of the protein can be then be cloned into a construct, such as those described herein, which can be a plasmid or other vector under control of appropriate transcription and translation sequences for high level protein expression in a biological system. A second gene or polynucleotide coding for the XTEN portion (in the case of FIG. 5 illustrated as an AE with 48 amino acid residues) can be genetically fused to the nucleotides encoding the N-terminus of the Ex4 gene by cloning it into the construct adjacent and in frame with the gene coding for the Ex4, through a ligation or multimerization step. In this manner, a chimeric DNA molecule coding for (or complementary to) the XTEN-Ex4 BPXTEN fusion protein would be generated within the construct. The construct can be designed in different configurations to encode the various permutations of the fusion partners as a monomeric polypeptide. For example, the gene can be created to encode the fusion protein in the order (N- to C-terminus): Ex-4-XTEN; XTEN-Ex4; Ex-4-XTEN-Ex4; XTEN-Ex-4-XTEN; as well as multimers of the foregoing. Optionally, this chimeric DNA molecule may be transferred or cloned into another construct that is a more appropriate expression vector. At this point, a host cell capable of expressing the chimeric DNA molecule would be transformed with the chimeric DNA molecule. The vectors containing the DNA segments of interest can be transferred into an appropriate host cell by well-known methods, depending on the type of cellular host, as described supra.

Host cells containing the XTEN-Ex4 expression vector would be cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, cells would be harvested by centrifugation, disrupted by physical or chemical means, and the resulting crude extract retained for purification of the fusion protein, as described below. For BPXTEN compositions secreted by the host cells, supernatant from centrifugation would be separated and retained for further purification.

Gene expression would be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression would be measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the Ex4 sequence polypeptide using a synthetic peptide based on the sequences provided herein or against exogenous sequence fused to Ex4 and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The XTEN-Ex4 polypeptide product would be purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

As illustrated in FIG. 6, the isolated XTEN-Ex4 fusion proteins would then be characterized for their chemical and activity properties. Isolated fusion protein would be characterized, e.g., for sequence, purity, apparent molecular weight, solubility and stability using standard methods known in the art. The fusion protein meeting expected standards would then be evaluated for activity, which can be measured in vitro or in vivo, using one or more assays disclosed herein; e.g., the assays of the Examples or Table 39.

In addition, the XTEN-Ex4 fusion protein would be administered to one or more animal species to determine standard pharmacokinetic parameters, as described in Example 25.

By the iterative process of producing, expressing, and recovering XTEN-Ex4 constructs, followed by their characterization using methods disclosed herein or others known in the art, the BPXTEN compositions comprising Ex4 and an XTEN can be produced and evaluated by one of ordinary skill in the art to confirm the expected properties such as enhanced solubility, enhanced stability, improved pharmacokinetics and reduced immunogenicity, leading to an overall enhanced therapeutic activity compared to the corresponding unfused Ex4. For those fusion proteins not possessing the desired properties, a different sequence can be constructed, expressed, isolated and evaluated by these methods in order to obtain a composition with such properties.

Example 19

Analytical Size Exclusion Chromatography of XTEN Fusion Proteins

Size exclusion chromatography analysis was performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 15. The data show that the apparent molecular weight of each compound is proportional to the length of the attached rPEG sequence. However, the data also show that the apparent molecular weight of each construct is significantly larger than that expected for a globular protein (as shown by comparison to the standard proteins run in the same assay). Based on the SEC analyses for all constructs evaluated, the Apparent Molecular Weights, the Apparent Molecular Weight Factor (expressed as the ratio of Apparent Molecular Weight to the calculated molecular weight) and the hydrodynamic radius ($R_H$ in nM) are shown in Table 26. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with glucose regulating peptides resulted with a hydrodynamic radius of 7 nm or greater; well beyond the glomerular pore size of approximately 3-5 nm. Accordingly, it is concluded that fusion proteins comprising glucose regulating peptides and XTEN would have reduced renal clearance, contributing to increased terminal half-life and improving the therapeutic or biologic effect relative to a corresponding un-fused biologically active protein.

TABLE 26

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
| --- | --- | --- | --- | --- | --- | --- |
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |

193

TABLE 26-continued

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1296 | IL-1ra | 134.8 | 2286 | 17.0 | 10.5 |

Example 20

Pharmacokinetics of Extended Polypeptides Fused to GFP in Cynomolgus Monkeys

Figure 23:
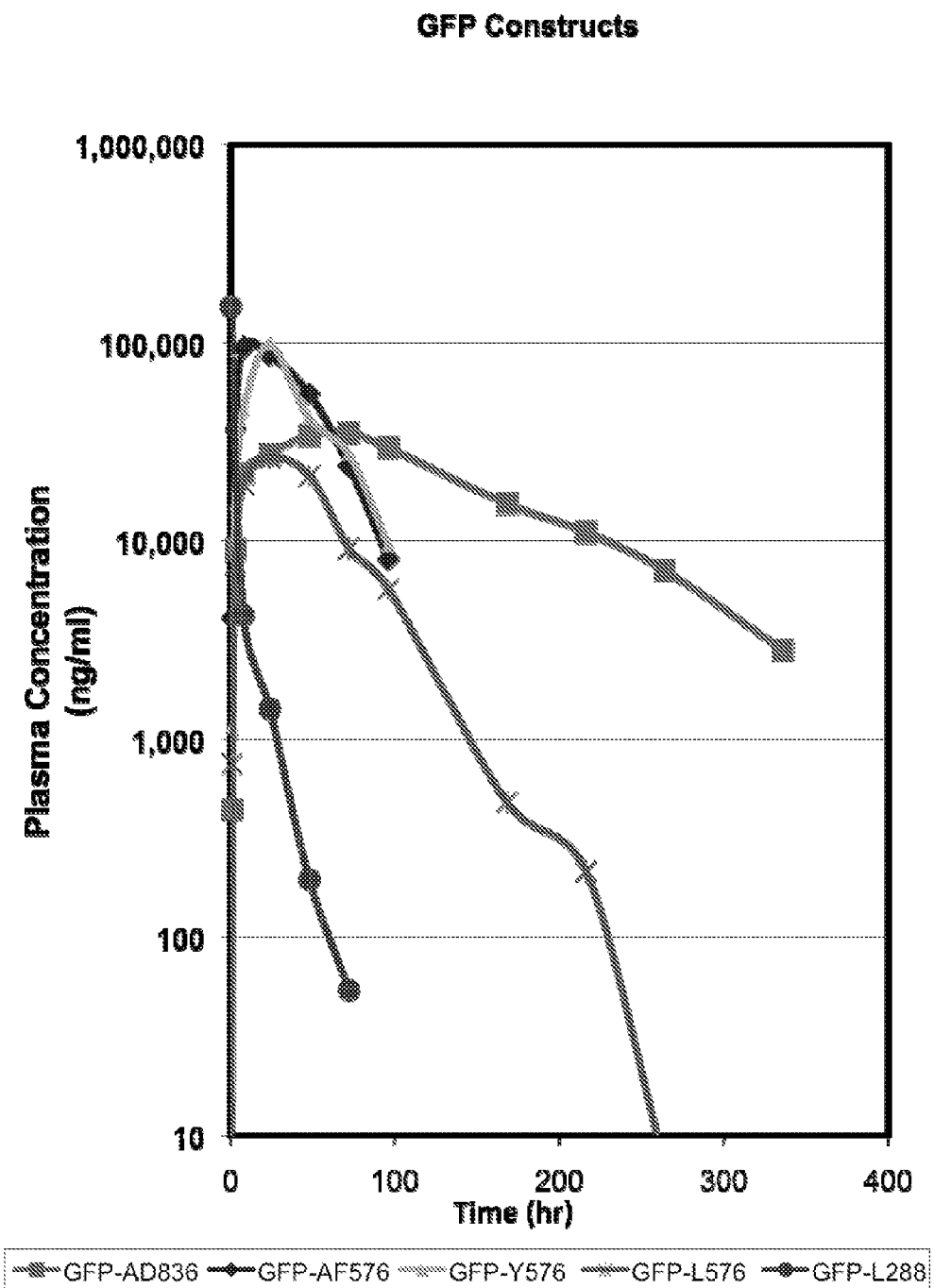
FIG. 23 shows the pharmacokinetic profile (plasma concentrations) in cynomolgus monkeys after single doses of different compositions of GFP linked to unstructured polypeptides of varying length, administered either subcutaneously or intravenously, as described in Example 20. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 23. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 21

Serum Stability of XTEN

Figure 13:
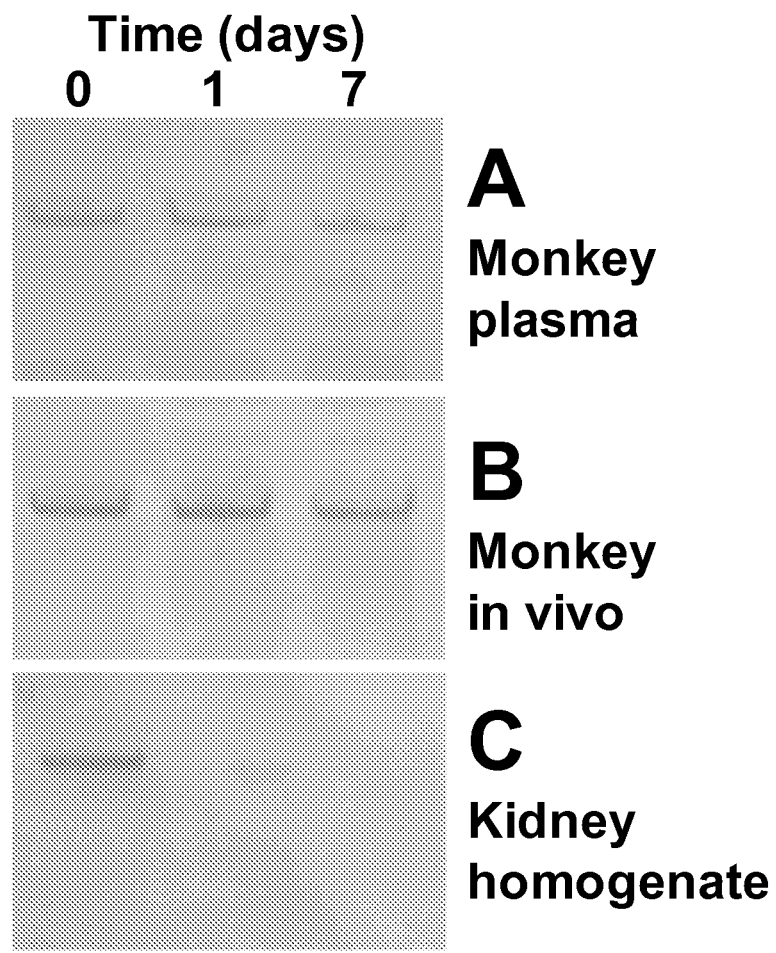
FIG. 13 shows an SDS-PAGE gel of samples from a stability study of the fusion protein of XTEN_AE864 fused to the N-terminus of GFP (see Example 21). The GFP-XTEN was incubated in cynomolgus plasma and rat kidney lysate for up to 7 days at 37° C. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 13. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of BPXTEN to degradation due to serum proteases; a factor in the enhancement of pharmacokinetic properties of the BPXTEN fusion proteins.

Example 22

Construction of BPXTEN Component XTEN_IL-1ra Genes and Vectors

Figure 7:
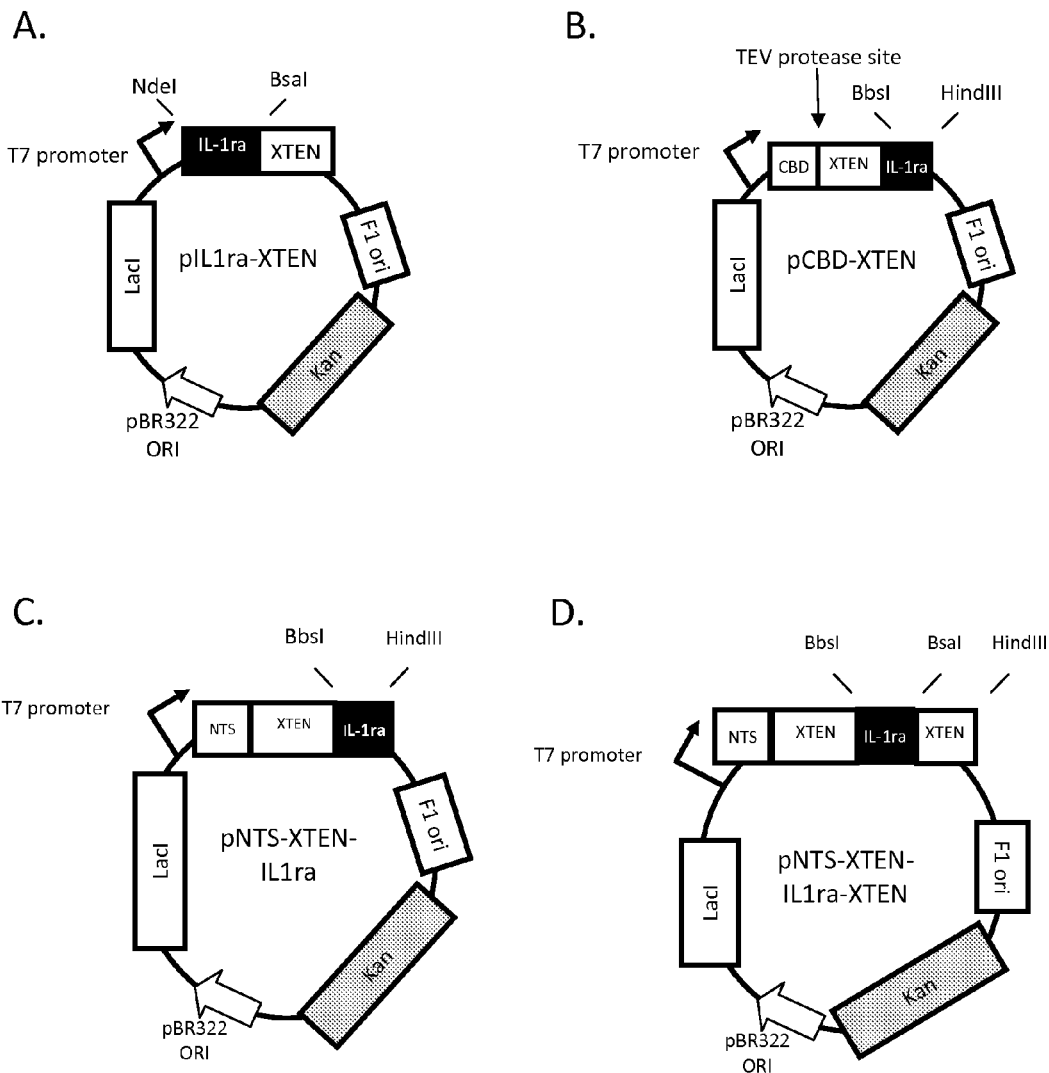
FIG. 7 is a schematic representation of the design of IL-1raXTEN expression vectors with different processing strategies.
Figure 8:
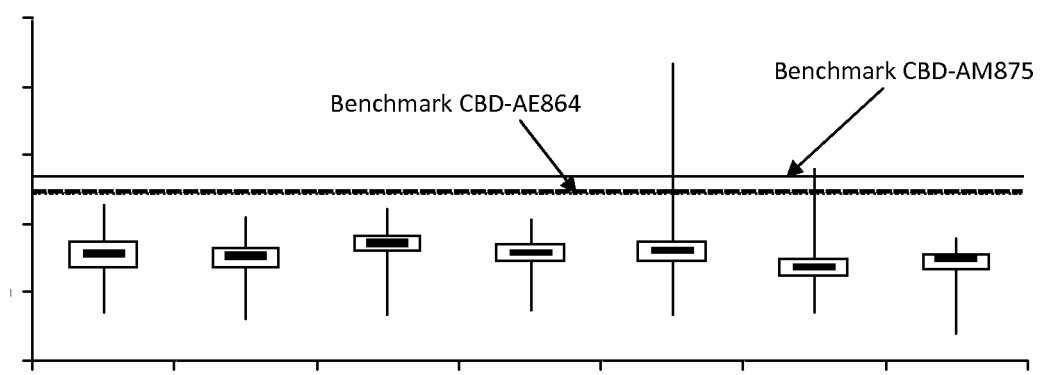
FIG. 8 shows results of expression assays for the indicated constructs comprising GFP and XTEN sequences. The expression cultures were assayed using a fluorescence plate reader (excitation 395 nm, emission 510 nm) to determine the amount of GFP reporter present. The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. The results also show that the libraries starting with amino acids MA had better expression levels than those beginning with ME (see Example 14).
Figure 10:
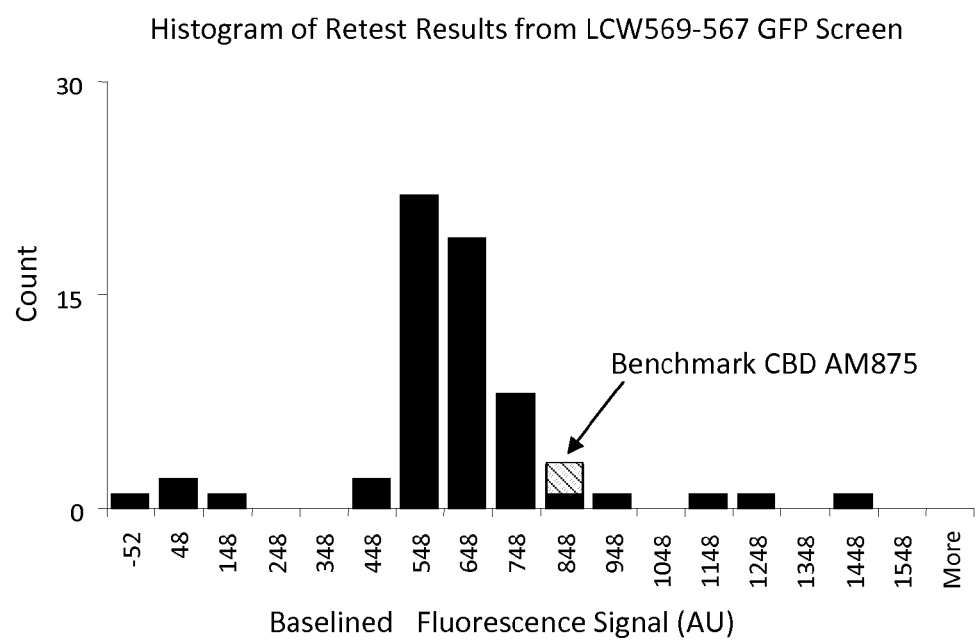
FIG. 10 shows a histogram of a retest of the top 75 clones after the optimization step, as described in Example 15, for GFP fluorescence signal, relative to the benchmark CBD_AM875 construct. The results indicated that several clones were now superior to the benchmark clones, as seen in FIG. 10.

The gene encoding human IL-1ra of 153 aa was amplified by polymerase chain reaction (PCR) with primers 5'-ATAAAGGGTCTCCAGGTCGTCCGTCCGGTCGTA-AATC (SEQ ID NO: 756) and 5'-AACTCGAAGCTT-TTATTCGTCCTCCTGGAAGTAAAA (SEQ ID NO: 757), which introduced flanking BsaI and HindIII (underlined) restriction sites that are compatible with the BbsI and HindIII sites that flank the stuffer in the XTEN destination vector (FIG. 7C). The XTEN destination vectors contain the kanamycin-resistance gene and are pET30 derivatives from Novagen in the format of Cellulose Binding Domain (CBD)-XTEN-Green Fluorescent Protein (GFP), where GFP is the stuffer for cloning payloads at C-terminus. Constructs were generated by replacing GFP in the XTEN destination vectors with the IL-1ra encoding fragment (FIG. 7). The XTEN destination vector features a T7 promoter upstream of CBD followed by an XTEN sequence fused in-frame upstream of the stuffer GFP sequence. The XTEN sequences employed are AM875, AM1318, AF875 and AE864 which have lengths of 875, 1318, 875 and 864 amino acids, respectively. The stuffer GFP fragment was removed by restriction digestion using BbsI and HindIII endonucleases. BsaI and HindIII restriction digested IL-1ra DNA fragment was ligated into the BbsI and HindIII digested XTEN destination vector using T4 DNA ligase and the ligation mixture was transformed into E. coli strain BL21 (DE3) Gold (Stratagene) by electroporation. Transformants were identified by the ability to grow on LB plates containing the antibiotic kanamycin. Plasmid DNAs were isolated from selected clones and confirmed by restriction analysis and DNA sequencing. The final vector yields the CBD_XTEN_IL-1ra gene under the control of a T7 promoter and CBD is cleaved by engineered TEV cleavage site at the end to generate XTEN_IL1-ra. Various constructs with IL-1ra fused at C-terminus to different XTENs include AC1723 (CBD-XTEN_AM875-IL-1ra), AC175 (CBD-XTEN_AM1318-IL-1ra), AC180 (CBD-XTEN_AF875-IL-1ra), and AC182 (CBD-XTEN_AE864-IL-1ra).

Example 23

Expression, Purification, and Characterization of Human Interleukin-1 Receptor Agonist (IL-1Ra) Fused to XTEN_AM875 and XTEN_AE864

Cell Culture Production

A starter culture was prepared by inoculating glycerol stocks of E. coli carrying a plasmid encoding for IL-1ra fused to AE864, AM875, or AM1296 into 100 mL 2×YT media containing 40 ug/mL kanamycin. The culture was then shaken overnight at 37° C. 100 mL of the starter culture was used to inoculate 25 liters of 2×YT containing 40 µg/mL kanamycin and shaken until the OD600 reached about 1.0

(for 5 hours) at 37° C. The temperature was then reduced to 26° C. and protein expression was induced with IPTG at 1.0 mM final concentration. The culture was then shaken overnight at 26° C. Cells were harvested by centrifugation yielding a total of 200 grams cell paste. The paste was stored frozen at −80° C. until use.

Purification of BPXTEN Comprising IL-1ra-XTEN AE864 or IL-1ra-AM875

Cell paste was suspended in 20 mM Tris pH 6.8, 50 mM NaCl at a ratio of 4 ml of buffer per gram of cell paste. The cell paste was then homogenized using a top-stirrer. Cell lysis was achieved by passing the sample once through a microfluidizer at 20000 psi. The lysate was clarified to by centrifugation at 12000 rpm in a Sorvall G3A rotor for 20 minutes.

Clarified lysate was directly applied to 800 ml of Macrocap Q anion exchange resin (GE Life Sciences) that had been equilibrated with 20 mM Tris pH 6.8, 50 mM NaCl. The column was sequentially washed with Tris pH 6.8 buffer containing 50 mM, 100 mM, and 150 mM NaCl. The product was eluted with 20 mM Tris pH 6.8, 250 mM NaCl.

A 250 mL Octyl Sepharose FF column was equilibrated with equilibration buffer (20 mM Tris pH 6.8, 1.0 M Na$_2$SO$_4$). Solid Na$_2$SO$_4$ was added to the Macrocap Q eluate pool to achieve a final concentration of 1.0 M. The resultant solution was filtered (0.22 micron) and loaded onto the HIC column. The column was then washed with equilibration buffer for 10 CV to remove unbound protein and host cell DNA. The product was then eluted with 20 mM Tris pH 6.8, 0.5 M Na$_2$SO$_4$.

The pooled HIC eluate fractions were then diluted with 20 mM Tris pH 7.5 to achieve a conductivity of less than 5.0 mOhms. The dilute product was loaded onto a 300 ml Q Sepharose FF anion exchange column that had been equilibrated with 20 mM Tris pH 7.5, 50 mM NaCl.

The buffer exchanged proteins were then concentrated by ultrafiltration/diafiltration (UF/DF), using a Pellicon XL Biomax 30000 mwco cartridge, to greater than 30 mg/ml. The concentrate was sterile filtered using a 0.22 micron syringe filter. The final solution was aliquoted and stored at −80° C., and was used for the experiments that follow, infra.

Figure 14:
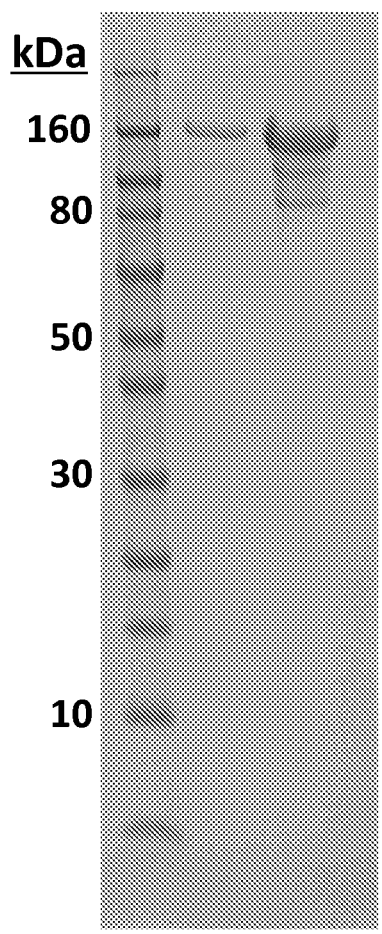
FIG. 14 shows two samples of 2 and 10 mcg of final purified protein of IL-1ra linked to XTEN_AE864 subjected to non-reducing SDS-PAGE, as described in Example 23. The results show that the IL-1raXTEN composition was recovered by the process, with an approximate MW of about 160 kDa.

SDS-PAGE Analysis 2 and 10 mcg of final purified protein were subjected to non-reducing SDS-PAGE using NuPAGE 4-12% Bis-Tris gel from Invitrogen according to manufacturer's specifications. The results (FIG. 14) show that the IL-1ra-XTEN_AE864 composition was recovered by the process detailed above, with an approximate MW of about 160 kDa.

Analytical Size Exclusion Chromatography

Figure 15:
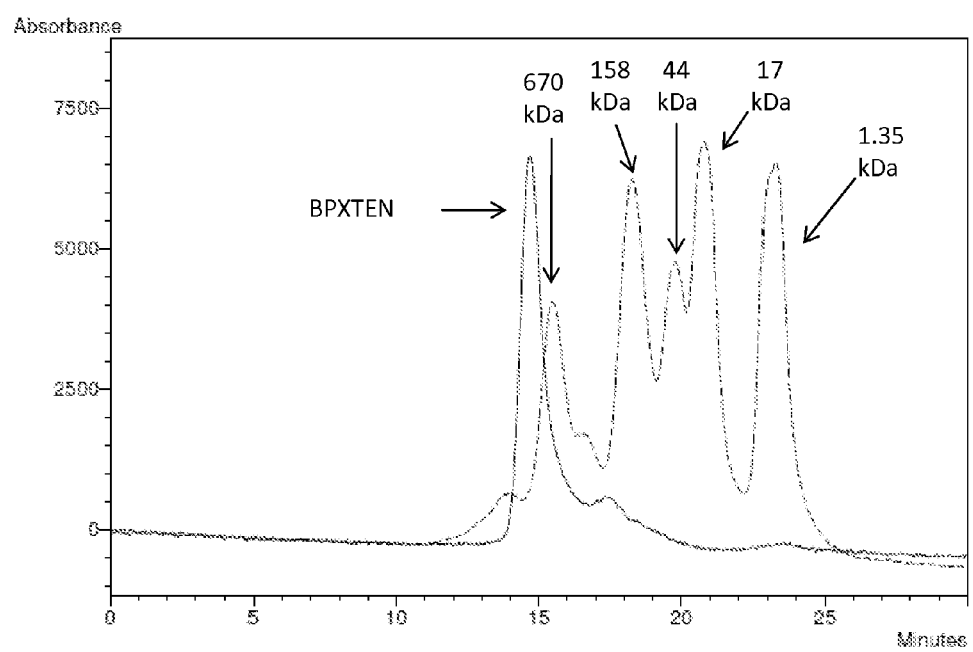
FIG. 15 shows the output of a representative size exclusion chromatography analysis performed as described in Example 23. The calibration standards, shown in the dashed line, include the markers thyroglobulin (670 kDa), bovine gamma-globulin (158 kDa), chicken ovalbumin (44 kDa), equine myoglobin (17 kDa) and vitamin B12 (1.35 kDa). The BPX- TEN component fusion protein of IL-1ra linked to XTEN_AM875 is shown as the solid line. The data show that the apparent molecular weight of the BPXTEN construct is significantly larger than that expected for a globular protein (as shown by comparison to the standard proteins run in the same assay), and has an Apparent Molecular Weight significantly greater than that determined by SDS-PAGE (data not shown).

Size exclusion chromatography analysis was performed using a Phenomenex BioSEP SEC 54000 (7.8×300 mm) column. 20 μg of the purified protein at a concentration of 1 mg/ml was separated at a flow rate of 0.5 ml/min in 20 mM Tris-Cl pH 7.5, 300 mM NaCl. Chromatogram profiles were monitored by absorbance at 214 and 280 nm. Column calibration was performed using a size exclusion calibration standard from BioRad, the markers include thyroglobulin (670 kDa), bovine gamma-globulin (158 kDa), chicken ovalbumin (44 kDa), equine myoglobuin (17 kDa) and vitamin B12 (1.35 kDa). A representative chromatographic profile of IL-1ra-XTEN_AM875 is shown in FIG. 15, where the calibration standards are shown in the dashed line and IL-1ra-XTEN_AM875 is shown as the solid line. The data show that the apparent molecular weight of each construct is significantly larger than that expected for a globular protein (as shown by comparison to the standard proteins run in the same assay), and has an Apparent Molecular Weight significantly greater than that determined by SDS-PAGE, describe above.

Analytical RP-HPLC

Figure 16:
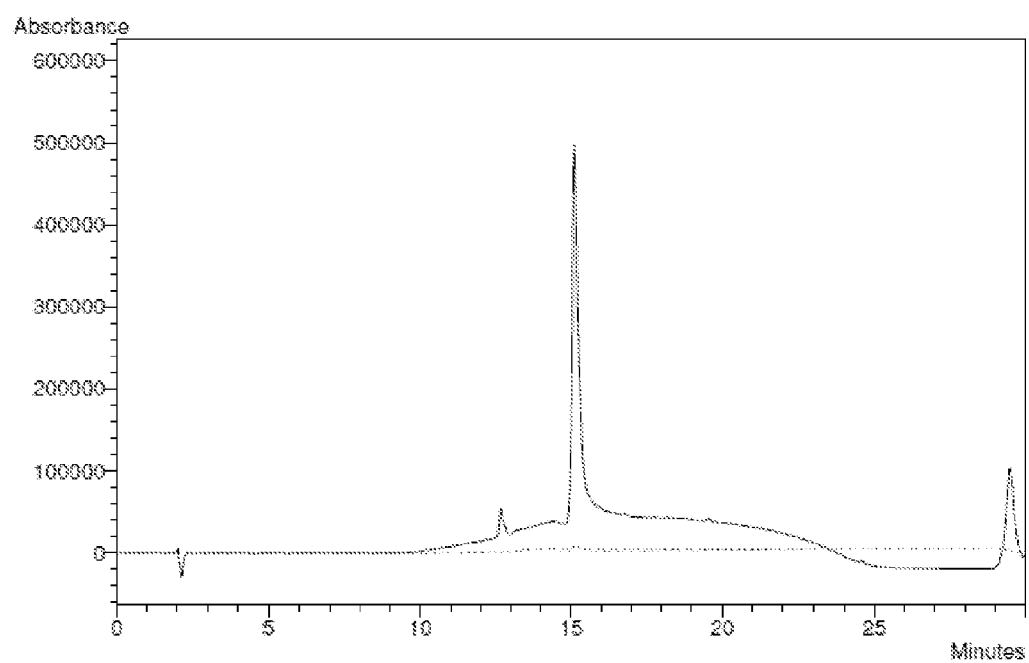
FIG. 16 shows the reverse phase C18 analysis of purified IL-1ra_XTEN_AM875 The output, in absorbance versus time, demonstrates the purity of the final product fusion protein.

Analytical RP-HPLC chromatography analysis was performed using a Vydac Protein C4 (4.6×150 mm) column. The column was equilibrated with 0.1% trifluoroacetic acid in HPLC grade water at a flow rate of 1 ml/min. Ten micrograms of the purified protein at a concentration of 0.2 mg/ml was injected separately. The protein was eluted with a linear gradient from 5% to 90% acetonitrile in 0.1% TFA. Chromatogram profiles were monitored using OD214 nm and OD280 nm. A chromatogram of a representative batch of IL-1ra-XTEN_AM875 is shown in FIG. 16.

IL-1 Receptor Binding

Figure 17:
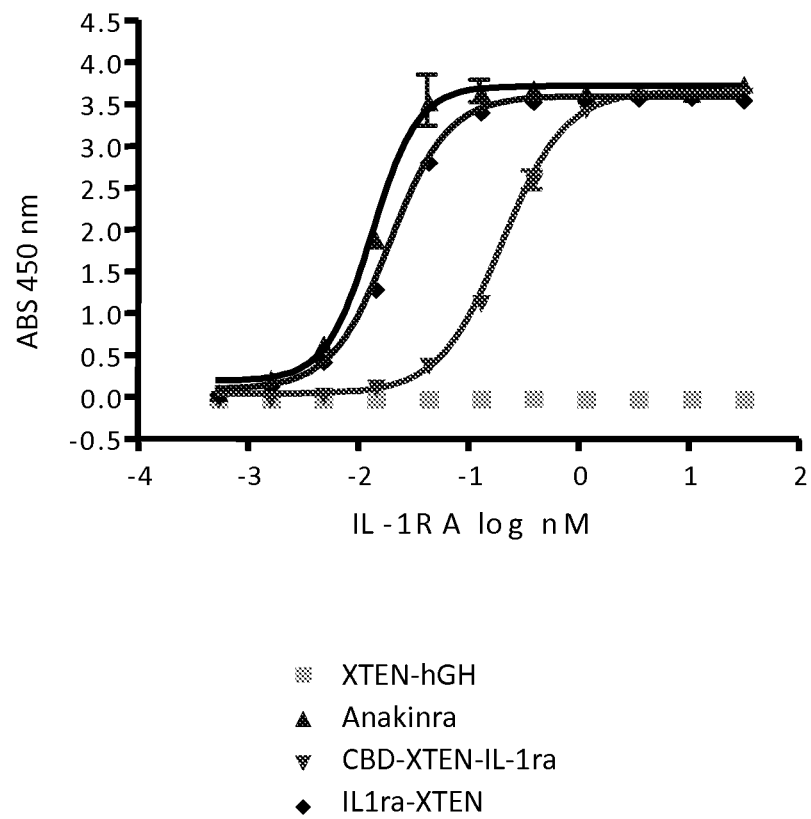
FIG. 17 shows the results of the IL-1 receptor binding assay, plotted as a function of IL-1ra-XTEN_AM875 or IL-1ra concentration to produce a binding isotherm. To estimate the binding affinity of each fusion protein for the IL-1 receptor, the binding data was fit to a sigmoidal dose-response curve. From the fit of the data an EC50 (the concentration of IL-1ra or IL-1ra-XTEN at which the signal is half maximal) for each construct was determined, as described in Example 23. The negative control XTEN_AM875-hGH construct showed no binding under the experimental conditions.

To evaluate the activity of the IL-1ra-containing XTEN fusion proteins, an ELISA based receptor binding assay was used. Here the wells of a Costar 3690 assay plate were coated overnight with 50 ng per well of mouse IL-1 receptor fused to Fc domain of human IgG (IL-1R/Fc, R&D Systems). Subsequently the wells were blocked with 3% BSA to prevent nonspecific interactions with the solid phase. After thoroughly washing the wells, a dilution series of either IL-1ra-XTEN_AM875, XTEN_AM875-IL-1ra, or IL-1ra (anakinra) was applied to the wells. The binding reaction was allowed to proceed for 2 hr at room temperature. Unbound Il-1ra was removed by repeated washing. The bound IL-1ra ad IL-1ra-XTEn fusions were detected with a biotinylated anti-human Il-1ra antibody and a horseradish peroxidase-conjugated streptavidin. The reaction was developed with TMB substrate for 20 minutes at room temperature. Color development was stopped with the addition of 0.2 N sulfuric acid. The absorbance of each well at 450 nm and 570 nm was recorded on a SpectrMax 384Plus spectrophotometer. The corrected absorbance signal ($Abs_{corr}=Abs_{450nm}-Abs_{570nm}$) was plotted as a function of IL-1ra-XTEN or IL-1ra concentration to produce a binding isotherm as shown in FIG. 17.

To estimate the binding affinity of each fusion protein for the IL-1 receptor, the binding data was fit to a sigmoidal dose-response curve. From the fit of the data an EC50 (the concentration of IL-1ra or IL-1ra-XTEN at which the signal is half maximal) for each construct was determined. As shown in FIG. 17, the EC50 of IL-1ra-XTEN_AM875, where the payload was attached to the N-terminus of the XTEN, was comparable to unmodified IL-1ra (anakinra EC50=0.013 nM, IL-1ra-XTEN_AM875 EC50=0.019 nM). XTEN_AM875-IL-1ra, where the payload was attached to the C-terminus of the XTEN, exhibited weaker binding with an EC50 (0.204 nM) that was approximately 15-fold higher that IL-1ra. The negative control XTEN_hGH construct showed no binding under the experimental conditions.

Thermal Stabilization of IL-1ra by XTEN

In addition to extending the serum half-life of protein therapeutics, XTEN polypeptides have the property improving the thermal stability of a payload to which it is fused. For example, the hydrophilic nature of the XTEN polypeptide may reduce or prevent aggregation and thus favor refolding of the payload protein. This feature of XTEN may aid in the development of room temperature stable formulations for a variety of protein therapeutics.

Figure 18:
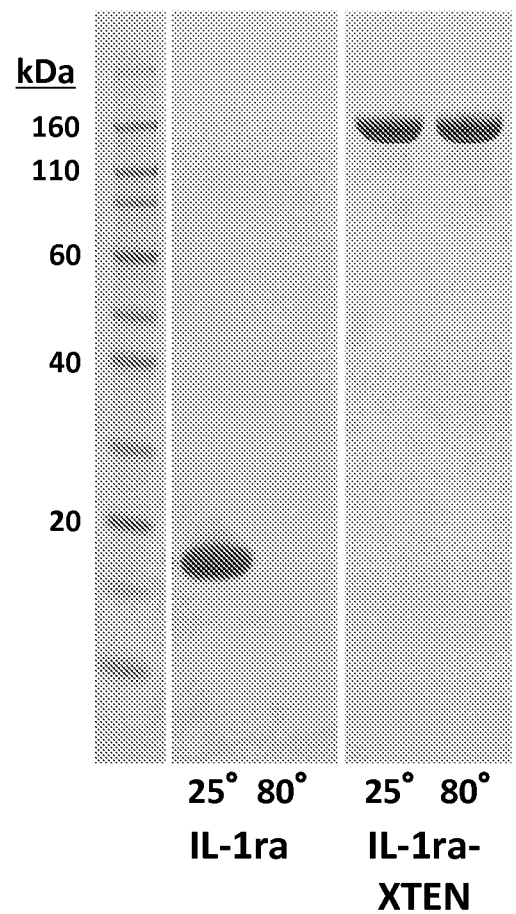
FIG. 18 shows an SDS-PAGE of a thermal stability study comparing IL-1ra to the BPXTEN of IL-1ra linked to XTEN_AM875, as described in Example 23. Samples of IL-1ra and the IL-1ra linked to XTEN were incubated at 25° C. and 85° C. for 15 min, at which time any insoluble protein was rapidly removed by centrifugation. The soluble fraction was then analyzed by SDS-PAGE as shown in FIG. 18, and shows that only IL-1ra-XTEN remained soluble after heating, while, in contrast, recombinant IL-1ra (without XTEN as a fusion partner) was completely precipitated after heating.

In order to demonstrate thermal stabilization of IL-1ra conferred by XTEN conjugation, IL-1ra-XTEN and recombinant IL-1ra, 200 micromoles per liter, were incubated at 25° C. and 85° C. for 15 min, at which time any insoluble protein was rapidly removed by centrifugation. The soluble fraction was then analyzed by SDS-PAGE as shown in FIG. 18. Note that only IL-1ra-XTEN remained soluble after heating, while, in contrast, recombinant IL-1ra (without XTEN as a fusion partner) was completely precipitated after heating.

Figure 19:
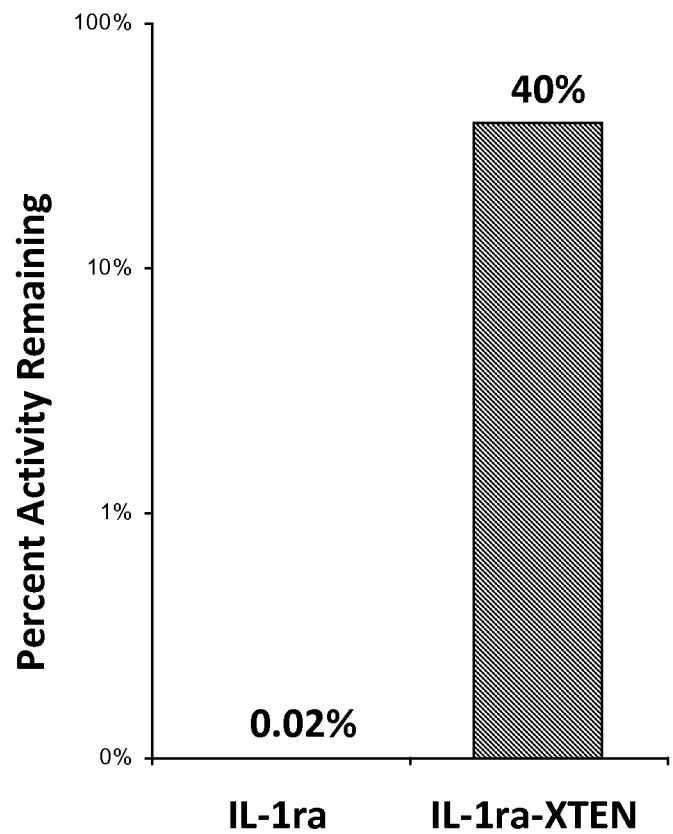
FIG. 19 shows the results of an IL-1ra receptor binding assay performed on the samples shown in FIG. 19. As described in Example 23, the recombinant IL-1ra, which was fully denatured by heat treatment, retained less than 0.1% of its receptor activity following heat treatment. However, IL-1ra linked to XTEN retained approximately 40% of its receptor binding activity.

The IL-1 receptor binding activity of IL-1ra-XTEN was evaluated following the heat treatment described above. Receptor binding was performed as described above. Recombinant IL-1ra, which was fully denatured by heat treatment, retained less than 0.1% of its receptor activity following heat treatment. However, IL-1ra-XTEN retained approximately 40% of its receptor binding activity (FIG. 19). Together these data demonstrate that the XTEN polypeptide can prevent thermal-induced denaturation of its payload fusion partner and support the conclusion that XTEN have stabilizing properties.

the terminal half-life was calculated to be approximately 15-28 hours for the various preparations over the 336 h period. For reference, the published half-life of unmodified IL-1ra is well described in the literature as 4-6 h in adult humans.

Conclusions:

The incorporation of different XTEN sequences into BPXTEN fusion proteins comprising IL-1ra results in significant enhancement of pharmacokinetic parameters for all three compositions, as demonstrated in the primate model, demonstrating the utility of such fusion protein compositions.

TABLE 27

PK parameters of BPXTEN compositions comprising IL-1ra and XTEN

| Dose | IL-1ra XTEN_AE864 10 mg/kg | IL-1ra-XTEN_AM1296 1 mg/kg | IL-1ra-XTEN_AM875 1 mg/kg | IL-1ra-XTEN_AM875 10 mg/kg | Units |
|---|---|---|---|---|---|
| Tmax | 24 | 48 | 24 | 24 | Hr |
| Cmax | 334,571.5 | 5,493.3 | 7,894.7 | 172,220.5 | ng/ml |
| t½ | 28.0 | 24.2 | 15.5 | 19.3 | Hr |
| AUCall | 9,830,115.9 | 372,519.3 | 485,233.9 | 11,410,136.2 | (ng*Hr)/ml |
| Vz(observed)/F | 165.7 | 337.1 | 149.2 | 88.4 | ml |
| Cl(observed)/F | 4.1 | 9.7 | 6.7 | 3.2 | ml/hr |

Example 24

PK Analysis of Fusion Proteins Comprising IL-1ra and XTEN

The BPXTEN fusion proteins IL-1ra_AE864, IL-1ra_AM875, and IL-1ra_AM1296 were evaluated in cynomolgus monkeys in order to determine in vivo pharmacokinetic parameters of the respective fusion proteins. All compositions were provided in an aqueous buffer and were administered by subcutaneous (SC) route into separate animals (n=4/group) using 1 mg/kg and/or 10 mg/kg single doses. Plasma samples were collected at various time points following administration and analyzed for concentrations of the test articles. Analysis was performed using a sandwich ELISA format. Rabbit polyclonal anti-XTEN antibodies were coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti IL-1ra antibody and streptavidin HRP. Concentrations of test article were calculated at each time point by comparing the colorimetric response at each serum dilution to a standard curve. Pharmacokinetic parameters were calculated using the WinNonLin software package.

Figure 20:
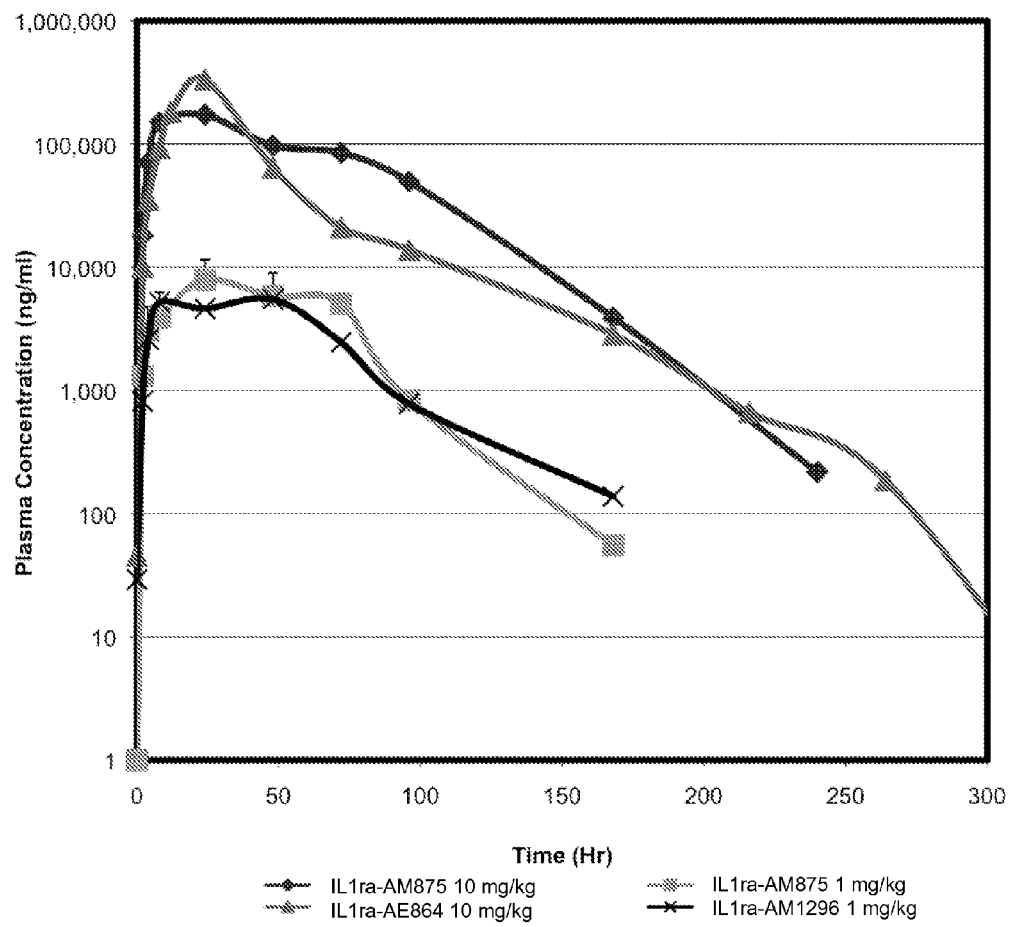
FIG. 20 shows the pharmacokinetic profile (plasma concentrations) after single subcutaneous doses of three different BPXTEN compositions of IL-1ra linked to different XTEN sequences, separately administered subcutaneously to cynomolgus monkeys, as described in Example 24.

FIG. 20 shows the concentration profiles of the four IL-1ra-containing constructs, and calculated PK parameters are shown in Table 27. Following subcutaneous administration, Example 25

PK Analysis of Fusion Proteins Comprising Exendin-4 and XTEN

The BPXTEN fusion protein Ex4_AE864 was evaluated in cynomolgus monkeys in order to determine in vivo pharmacokinetic parameters of the fusion proteins after a single subcutaneous dose.

Methods:

The BPXTEN fusion protein was formulated in 20 mM Tris, pH 7.5, 135 mM NaCl at two different concentrations; 8 mg/mL and 40 mg/mL. Three groups of four monkeys (2 males and 2 females, 2-6 kg) each were dosed at 1 mg/kg (Group 1, 0.125 mL/kg), 1 mg/kg (Group 2, 0.025 mL/kg), or 5 mg/kg (Group 3, 0.125 mL/kg) via bolus injection between the skin and underlying layers of tissue in the scapular region on the back of each animal. Serial blood samples (1 ml±0.5 ml) were drawn over fourteen days from the femoral vein or artery of previously acclimated animals through a syringe with no aesthesia utilizing chair restraint. If necessary, chair restraint was utilized for a maximum of 30 minutes. All animals were fasted overnight prior to dosing and through the first 4 hours of blood sample collection (food was returned within 30 minutes following collection of the last blood sample at the 4 hour collection interval, where applicable). Each blood sample was collected into heparin plasma separator and kept on ice (2° C. to 8° C.) for approximately 5 minutes pending centrifugation. The blood samples were centrifuged (8,000×g for 5 min) and the plasma was transferred into a polypropylene tube. Plasma samples were snap frozen, and stored at approximately −70° C. until assayed. Analysis was performed using a sandwich ELISA format.

Results:

The pharmacokinetic parameters were calculated for the monkeys and the results are tabulated in Table 28. The pharmacokinetic parameters were analyzed using both a naïve pooling of all animals and using a standard two-stage analysis. The results show a difference in absorption of the fusion protein, based on dose volume administered in Group 1 versus Group 2, as evidenced by the Tmax, Cmax, AUC and volume of distribution (Vz) values. However, the calculated half-life values are comparable across the three Groups, and greatly exceed the reported terminal half-life of exenatide of 2.4 h.

TABLE 28

Pharmacokinetic Parameters Calculated from Group Average for Administered BPXTEN.

| Parameter | Group 1 Avg | Group 2 Avg | Group 3 Avg |
|---|---|---|---|
| Tmax | 96 | 24 | 48 |
| Cmax | 4,860 | 3,879 | 18,713 |
| Lambda_z_lower | 96 | 96 | 96 |
| Lambda_z_upper | 336 | 336 | 336 |
| t½_Lambda_z | 83.8 | 76.8 | 74.0 |
| AUCall | 739,850 | 524,615 | 2,445,751 |
| Vz(observed)/F | 579 | 871 | 986 |
| Cl(observed)/F | 4.8 | 7.9 | 9.2 |
| Vz(observed)/F | 148 | 199 | 207 |

Conclusions:

The linking of exendin-4 to XTEN to create a BPXTEN fusion results in significant enhancement of pharmacokinetic parameters for all three formulations, as demonstrated in the primate model, with an increase of at least 30-fold in the half-life, demonstrating the utility of such fusion protein compositions.

Example 26

Use of BPXTEN in Diet-Induced Obese Mouse Model

The effects of combination therapy of glucose regulating peptides linked to XTEN were evaluated in a mouse model of diet-induced obesity to confirm the utility of fixed combinations of monomeric fusion proteins as a single BPXTEN composition.

Methods:

The effects of combination therapy of glucagon linked to Y-288-XTEN ("Gcg-XTEN") and exenatide linked to AE576-XTEN ("Ex-4-XTEN") or exenatide singly were tested in male C57BL/6J Diet-Induced Obese (DIO) Mice, age 10 weeks old. Mice raised on a 60% high fat diet were randomized into the treatment groups (n=10 per group) Ex-4-XTEN864 (10 mg/kg IP Q2D), Ex-4-XTEN864 (20 mg/kg IP Q4D), Ex-4-XTEN864 (10 mg/kg IP Q2D) plus Gcg-XTEN288 (20 µg/kg IP BID), and Ex-4-XTEN864 (20 mg/kg IP Q4D) plus Gcg-XTEN288 (40 µg/kg IP Q1D). A placebo group (n=10) treated with 20 mM Tris pH 7.5, 135 mM NaCl IP Q1D was tested in parallel. All groups were dosed continuously for 28 days. Body weight was monitored at regular intervals throughout the study and fasting blood glucose was measured before and after the treatment period. Groups were dosed continuously for a 28 day treatment period. Body weight was monitored continuously throughout the study and fasting blood glucose was measured before and after the treatment period, and lipid levels were determined after the treatment period.

Figure 21:
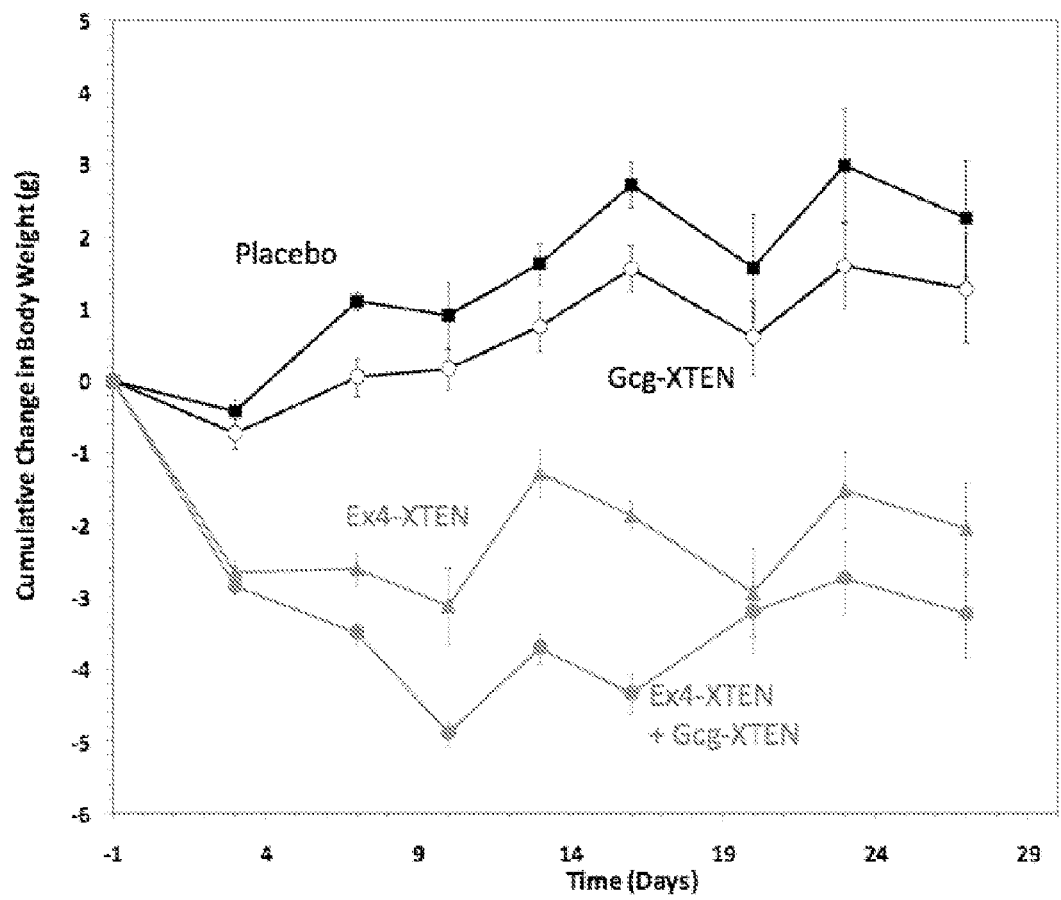
FIG. 21 shows body weight results from a pharmacodynamic and metabolic study using a combination of two fusion proteins; i.e., glucagon linked to Y288 (Gcg-XTEN) and exendin-4 linked to AE864 (Ex-4-XTEN) combination efficacy in a diet-induced obesity model in mice (see Example 26 for experimental details). The graph shows change in body weight in Diet-Induced Obese mice over the course of 28 days continuous drug administration. Values shown are the average+/−SEM of 10 animals per group (20 animals in the placebo group).
Figure 22:
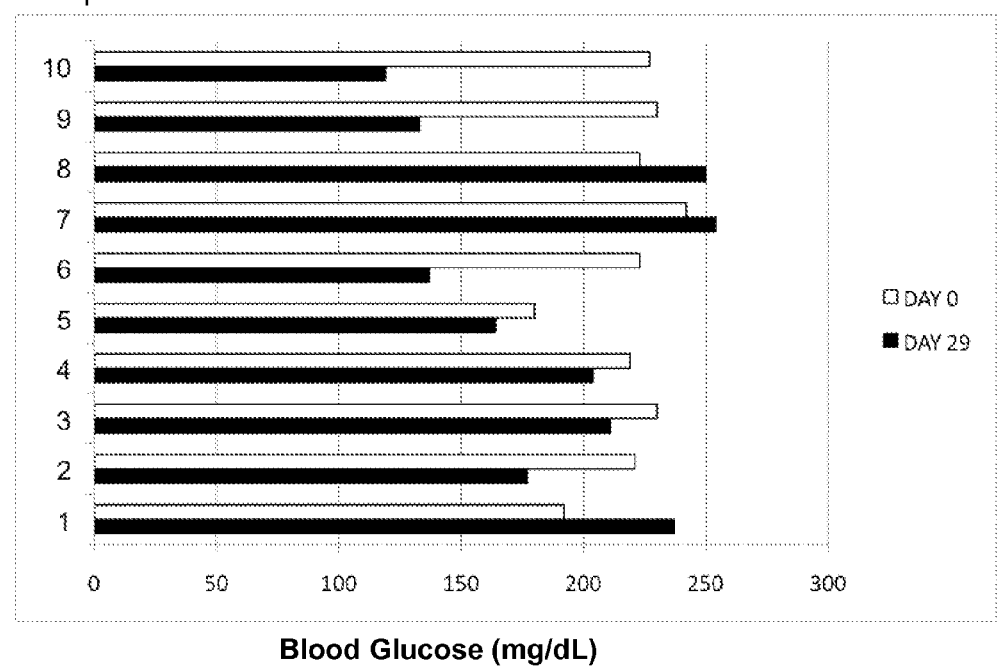
FIG. 22 shows change in fasting glucose levels from a pharmacodynamic and metabolic study using single and combinations of two BPXTEN fusion proteins; i.e., glucagon linked to Y288 (Gcg-XTEN) and exendin-4 linked to AE864 (Ex-4-XTEN) in a diet-induced obesity model in mice (see Example 26 for experimental details). Groups are as follows: Gr. 1 Tris Vehicle; Gr. 2 Ex-4-AE576, 10 mg/kg; Gr. 3 Ex-4-AE576, 20 mg/kg; Gr. 4 Vehicle, 50% DMSO; Gr. 5 Exenatide, 30 µg/kg/day; Gr. 6 Exenatide, 30 uL/kg/day+Gcg-Y288 20 µg/kg; Gr. 7 Gcg-Y288, 20 µg/kg; Gr. 8 Gcg-Y288, 40 µg/kg; Gr. 9 Ex-4-AE576 10 mg/kg+Gcg-Y288 20 µg/kg; Gr. 10 Gcg-Y288 40 µg/kg+Ex-4-AE576 20 mg/kg. The graph shows the change in fasting blood glucose levels in Diet-Induced Obese mice over the course of 28 days continuous drug administration. Values shown are the average+/−SEM of 10 animals per group (20 animals in the placebo group).

Results: The results are shown in FIGS. 21-22. The data indicate that continuous dosing for one month yielded a significant reduction in weight gain in the animals treated with Gcg-XTEN alone and Ex-4-XTEN alone, relative to placebo over the course of the study. In addition, animals dosed with Ex-4-XTEN or Gcg-XTEN and Ex-4-XTEN concurrently showed a statistically significantly greater weight loss compared to Gcg-XTEN administered alone and compared to placebo. The toxic effects of glucagon administration are well documented. The maximum no-effect dose for glucagon in rats and beagle dogs has recently been reported as 1 mg/kg/day was regarded as a clear no-toxic-effect-level in both species (Eistrup C, Glucagon produced by recombinant DNA technology: repeated dose toxicity studies, intravenous administration to CD rats and beagle dogs for four weeks. Pharmacol Toxicol. 1993 August; 73(2):103-108).

The data also show that continuous dosing for one month yielded a significant reduction in fasting blood glucose for the animals treated with Ex-4-XTEN alone relative to placebo, but not for animals treated with Gcg-XTEN alone. However, animals dosed with both Gcg-XTEN and exenatide concurrently showed a statistically significantly greater reduction in fasting blood glucose levels compared to either glucose regulating peptide administered alone. Of note, the doses of Gcg-XTEN composition that resulted in the beneficial effects in combination with Ex-4-XTEN were 20 and 40 µg/kg (complete fusion protein composition weight); at least 25-fold lower than the no-effect dose reported for glucagon alone in a rodent species.

Conclusions:

The data support the conclusion that combination therapy with two fusion proteins of glucose regulating peptides linked to XTEN can result in a synergistic beneficial effect over that seen with a single glucose regulating peptide such that administration of a combination composition can be tailored to reduce frequency of dosing or dosage compared to administration of a single biologic in order to reduce the threat of toxicity or unacceptable side effects.

Example 27

PK Analysis of Ex-4-XTEN BPXTEN in Cynomolgus Monkeys

The pharmacokinetics of Ex-4-AE864 BPXTEN were determined in cynomolgus monkeys (three per group) with the BPXTEN administered by subcutaneous or intravenous injections of BPXTEN at 0.5 mg/kg over a 1 minute period. Plasma samples were collected at various time points up to 14 days after injection and analyzed by ELISA for determination of both test article serum concentration and immunogenicity. No anti-test article antibody response was observed for Ex-4-AE864 in any animal after administration. Sandwich ELISA was carried out by >12 h immobilization of 100 ng capture antibody (rabbit anti-exenatide, Peninsula Laboratories, San Carlos, Calif.) to each well in a polystyrene microtiter plate (Costar 3690, Corning Inc, Corning, N.Y.), followed by blocking with 3% bovine serum albumin (BSA). After 3 washes with PBS, plasma samples were serially titrated across the plate in PBS containing 1% BSA and 0.5% Tween 20. After a 2 hour incubation and washing, the samples were probed by the addition of biotinylated IgG (rabbit anti-exenatide biotinylated in house, Peninsula Laboratories, San Carlos, Calif.) to each well. After incubation and washing, plates were developed by incubation with horseradish peroxidase-conjugated streptavidin (Thermo Fisher Scientific, Rockford, Ill.) followed by tetramethylbenzidine substrate (Neogen Corporation, Lexington, Ky.), then quenched with 0.2 N $H_2SO_4$ and read at 450 nm. Non compartmental pharmacokinetic parameters were calculated using the WinNonLin program, Version 2.1 (Pharsight Corporation, Mt. View, Calif.).

Figure 25:
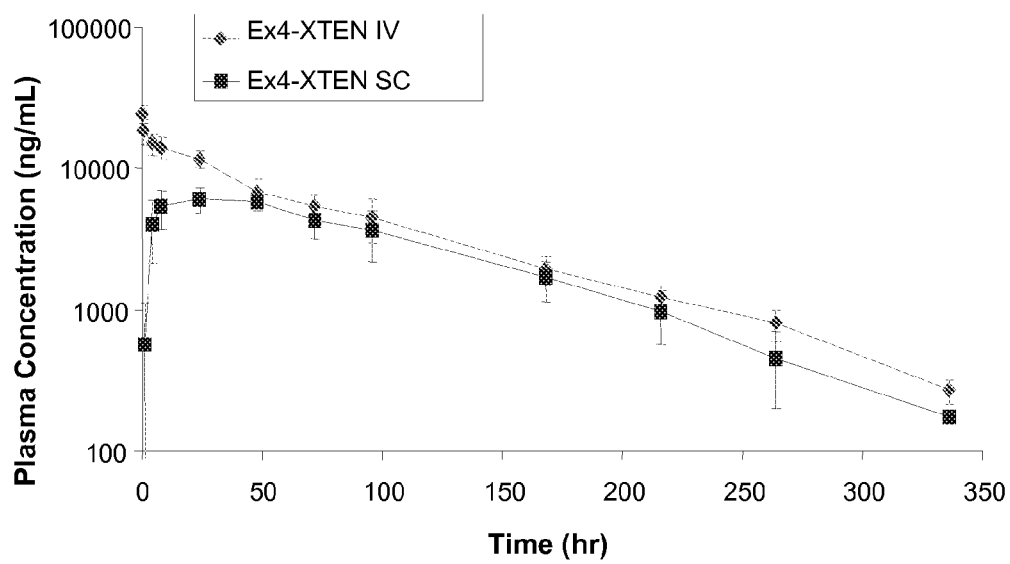
FIG. 25 shows the pharmacokinetic results of Ex-4-AE864 administered to cynomolgus monkeys by the subcutaneous and intravenous routes (see Example 27 for experimental details).

The results are depicted in FIG. 25. Terminal half-life of this formulation of the construct was 60 hours, with 80% bioavailability from a subcutaneous injection. This compares to the reported half-life of 2.4 h for Byetta®, a commercial version of exendin-4. Importantly, a slow absorption phase, which appears to be characteristic of XTEN fusion proteins, was noted after subcutaneous injection. The absorption phase resulted in a Cmax between 24-48 hours after injection and an essentially flat serum concentration profile for ~100 hours before reaching a linear elimination phase.

Conclusions:

It can be concluded from the results that addition of an XTEN to a glucose-regulating peptide, such as exendin-4, can greatly increase the terminal half-life compared to the peptide not linked to XTEN, and enhance other pharmacokinetic parameters, as well.

Example 28

Figure 26:
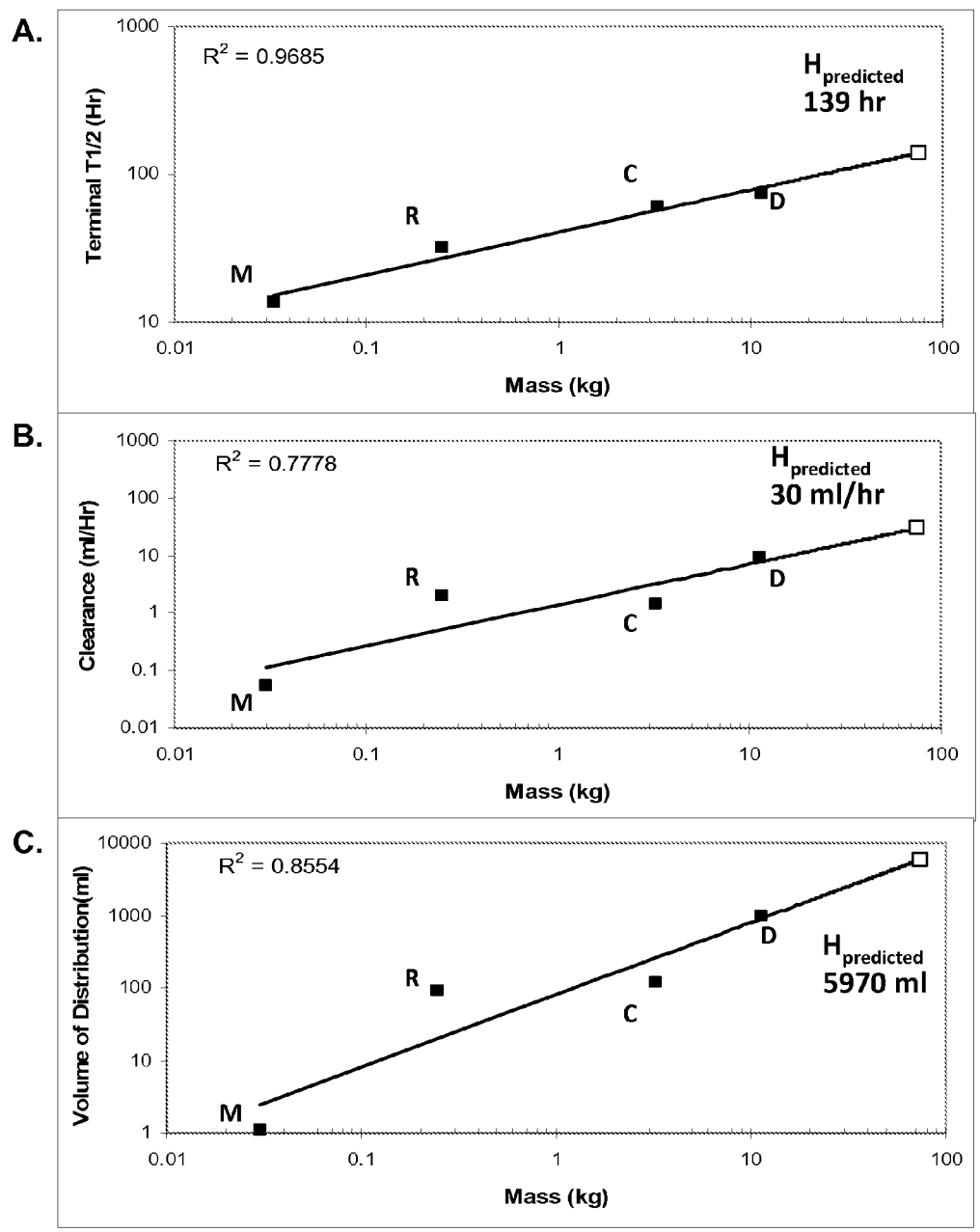
FIG. 26 illustrates allometric scaling results for predicted human response to Ex-4-XTEN_AE864 based on measured results from four animal species; i.e., mice, rats, cynomolgus monkeys and dogs.

PK Analysis of Ex-4-XTEN BPXTEN in Multiple Species and Predicted Human Half-Life To determine the predicted pharmacokinetic profile in humans of a therapeutic protein fused to XTEN, studies were performed using exendin-4 fused to the AE864 XTEN as a single fusion polypeptide. The Ex-4-XTEN construct was administered to four different animal species at 0.5-1.0 mg/kg, subcutaneously and intravenously. Serum samples were collected at intervals following administration, with serum concentrations determined using standard methods. The half-life for each species was determined, and is tabulated in Table 29. The results were used to predict the human half-life using allometric scaling of terminal half-life, volume of distribution, and clearance rates based on average body mass. FIG. 26A shows a plot of measured terminal half-life versus body mass in the animal species, with a predicted $T_{1/2}$ in a 75 kg human of 140 h, compared to the reported half-life of exenatide of 2.4 h (Bond, A. Proc (Bayl Univ Med Cent) 19(3): 281-284. (2006)). FIG. 26B shows measured drug clearance versus body mass, with a predicted clearance rate value of 30 ml/h in a 75 kg human. FIG. 26C shows measured volume of distribution versus body mass, with a predicted value of 5970 ml in a 75 kg human.

Conclusions:

It can be concluded from the results that addition of an XTEN to a glucose-regulating peptide, such as exendin-4, can greatly increase the terminal half-life compared to the peptide not linked to XTEN, and that a BPXTEN formulation with comparable half-life would permit considerably less frequent dosing than is currently employed with commercial products of glucose-regulating peptides, with dosing at weekly, every other week, or even monthly intervals.

TABLE 29

Half-life of Ex4-XTEN

| Species | Half-Life (hr) |
|---|---|
| Mouse | 13.5 |
| Rat | 31.7 |
| Monkey | 60.7 |
| Dog | 72.8 |
| Human | 140* |

*Predicted value based on allometric scaling

Example 29

Increasing Solubility and Stability of BP by Linking to XTEN

In order to evaluate the ability of XTEN to enhance the physical/chemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 30. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 BPXTEN was evaluated for stability, and was found to be stable in liquid formulation for at least 6 months under refrigerated conditions and for approximately one month at 37° C. (data not shown).

Conclusions:

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 30

Solubility of Glucagon-XTEN constructs

| Test Article | Solubility |
|---|---|
| Glucagon | 60 µM |
| Glucagon-Y36 | >370 µM |
| Glucagon-Y72 | >293 µM |
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Example 30

Characterization of BPXTEN Secondary Structure

Figure 24:
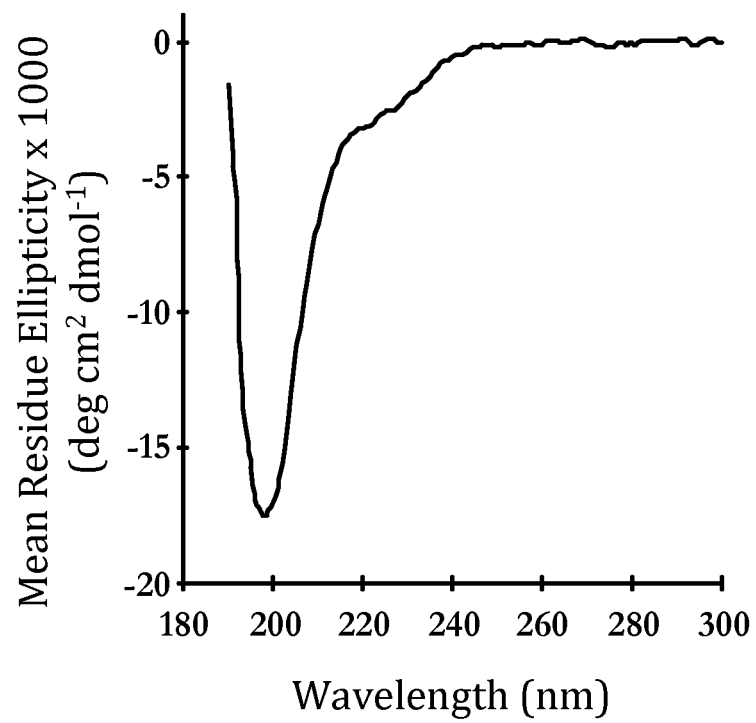
FIG. 24 shows the near UV circular dichroism spectrum of Ex-4-XTEN_AE864, performed as described in Example 30.

The BPXTEN Ex-4-AE864 was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical pathlength of 0.1 cm. The CD spectra were acquired at 5°, 25°, 45°, and 65° C. and processed using the J-700 version 1.08.01 (Build 1) Jasco software for Windows. The samples were equilibrated at each temperature for 5 mM before performing CD measurements. All spectra were recorded in duplicate from 300 nm to 185 nm using a bandwidth of 1 nm and a time constant of 2 sec, at a scan speed of 100 nm/min. The CD spectrum shown in FIG. 24 shows no evidence of stable secondary structure and is consistent with an unstructured polypeptide.

Example 31

Biological Activity of Glucagon and Ex4 BPXTEN Constructs

Figure 27:
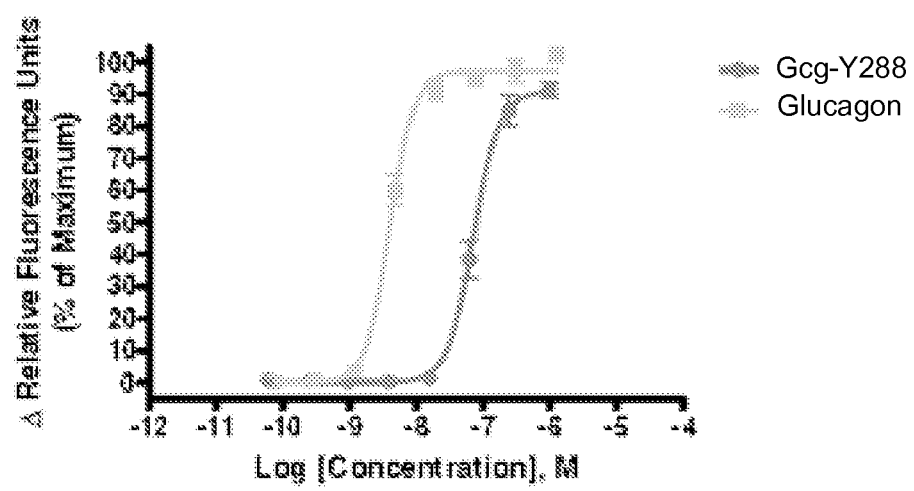
FIG. 27 shows the results of an in vitro cellular assay for glucagon activity, comparing glucagon to glucagon linked to Y288 (see Example 31 for experimental details).
Figure 28:
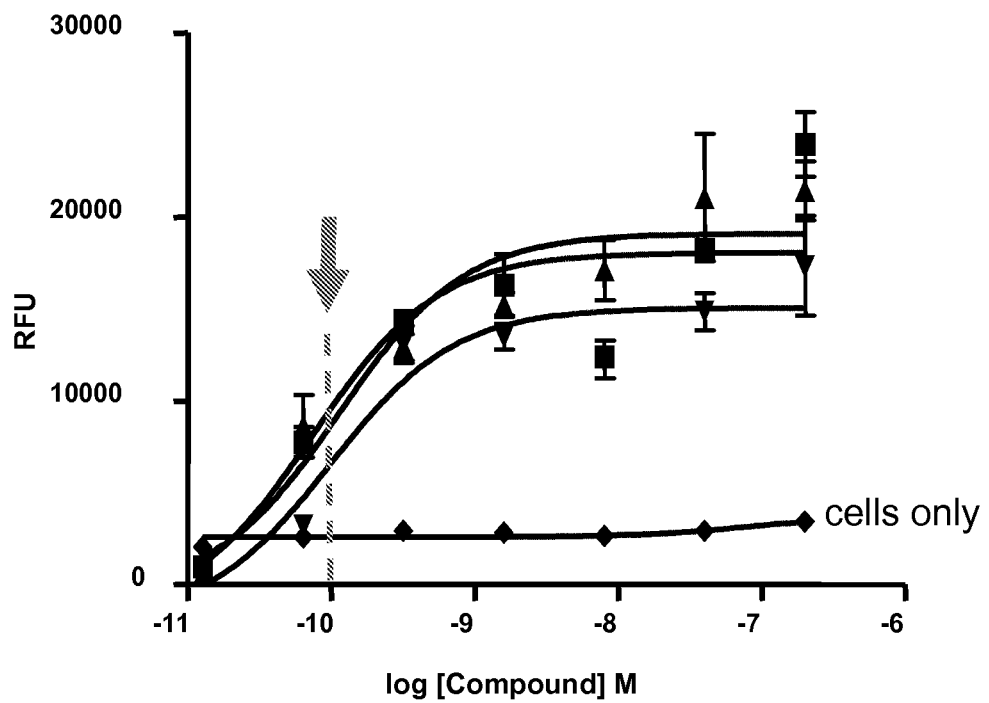
FIG. 28 shows the results of an in vitro cellular assay for GLP-1 activity, comparing exendin-4 from two commercial sources (closed triangles) to exendin-4 linked to Y288 (closed squares), with untreated cells (closed diamonds) used as a negative control (see Example 31 for experimental details). The EC50 is indicated by the dashed line.

Purified glucagon and exendin-3, each linked to Y288 as a BPXTEN fusion protein, were assayed for biological activity using an in vitro cell assay. Briefly, a ChemiScreen Stable Calcium Optimized glucagon receptor cell line was used for real-time calcium mobilization assays for glucagon and the glucagon-XTEN constructs, while an optimized exendin-4 receptor cell line expressing native GLP-1 receptor was used for exendin-4 and the Ex4 constructs. In this system, the cells express the native receptors and activation of this receptor results in calcium flux within the cell that can be detected using a FLIPR apparatus. As shown in FIG. 27, native glucagon results in an increase in signal in a dose-dependant manner. The EC50 for native glucagon in this system was found to be 4.1 nM. Titration of the glucagon-Y288 construct yielded a comparable response curve, with an EC50 of 72 nM. As shown in FIG. 28, native exendin-4 from two different commercial sources (Anaspec and Tocris) results in an increase in signal in a dose-dependant manner, with EC50s (indicated at dashed line) of 75 µM and 110 µM, respectively. Titration of the exendin-4-Y576 construct yielded a comparable response curve, with an EC50 of 98 µM, indicating that the fusion of the accessory protein retains full biological activity.

Conclusions:

The results indicate that the fusion of the glucose-regulating peptides to an unstructured recombinant protein results in compositions that retain biological activity.

Example 32

Construction of hGH_XTEN-AE and hGH_XTEN-AM Genes and Vectors

The gene encoding hGH was amplified by polymerase chain reaction (PCR), which introduced NdeI and BbsI restriction sites that are compatible with the NdeI and BsaI sites that flank the stuffer in the XTEN destination vector. The pXTEN plasmid is a pET30 derivative from Novagen in the format of Stuffer-XTEN, where Stuffer can be either green fluorescent protein (GFP) or CBD and XTEN can be any length from 36 to 576 or greater. Constructs were generated by replacing a stuffer sequence in pXTEN with the hGH-encoding fragment. The pXTEN features a T7 promoter upstream of the stuffer sequence, and an XTEN sequence fused in-frame downstream of the stuffer sequence. The XTEN sequences employed belong to family XTEN_AE or XTEN_AM and encode lengths that include 36, 72, 144, 288, 576, 864, 875 and 1296 amino acids. The stuffer fragment was removed by restriction digest using NdeI and BsaI endonucleases. Restriction digested hGH DNA fragment was ligated into the cleaved pXTEN vector using T4 DNA ligase and electroporated into BL21(DE3) Gold (Stratagene). Transformants were screened by DNA miniprep and the desired construct was confirmed by DNA sequencing. The final vector yields the hGH_XTEN gene under the control of a T7 promoter.

Example 33

Construction of XTEN-AE_hGH and XTEN-AM_hGH Genes and Vectors

The gene encoding hGH was amplified by polymerase chain reaction (PCR), which introduced BbsI and HindIII restriction sites that are compatible with the BbsI and HindIII sites that flank the stuffer in the XTEN destination vector. The pCBD-XTEN plasmid is a pET30 derivative from Novagen in the format of Cellulose Binding Domain (CBD)-XTEN-Stuffer, where Stuffer is green fluorescent protein (GFP) and XTEN can be any length from 36 to 576 or greater. Constructs were generated by replacing a stuffer sequence in pCBD-XTEN with the hGH-encoding fragment. The pCBD-XTEN features a T7 promoter upstream of CBD followed by an XTEN sequence fused in-frame upstream of the stuffer sequence. The XTEN sequences employed belong to family XTEN_AE and XTEN_AM and encode lengths that include 36, 72, 144, 288, 576, 864, 875 and 1296 amino acids. The stuffer fragment was removed by restriction digest using BbsI and HindIII endonucleases. Restriction digested hGH DNA fragment was ligated into the cleaved pCBD-XTEN vector using T4 DNA ligase and electroporated into BL21(DE3) Gold (Stratagene). Transformants were screened by DNA miniprep and the desired construct was confirmed by DNA sequencing. The final vector yields the CBD_XTEN_hGH gene under the control of a T7 promoter.

Example 34

Construction of XTEN-AE_hGH_XTEN-AE hGH Genes and Vectors

The gene encoding hGH was amplified by polymerase chain reaction (PCR), which introduced BbsI and BsaI restriction sites that are compatible with the BbsI and BsaI sites that flank the stuffer in the XTEN destination vector. The pNTS-XTEN plasmid is a pET30 derivative from Novagen in the format of N-terminal XTEN expression sequence of 48 amino acids, where Stuffer is green fluorescent protein (GFP) and XTEN can be any length from 36 to 576 or greater. Constructs were generated by replacing a stuffer sequence in pCBD-XTEN with the hGH-encoding fragment. The pNTS-XTEN features a T7 promoter upstream of NTS followed by an XTEN sequence fused in-frame upstream of the stuffer sequence. The XTEN sequences employed belong to family XTEN_AE and encode lengths that include 36, 72, 144, 288, 576, 864, and 1296 amino acids. The stuffer fragment was removed by restriction digest using BbsI and BsaI endonucleases. Restriction digested hGH DNA fragment was ligated into the cleaved pNTS-XTEN vector using T4 DNA ligase and electroporated into BL21(DE3) Gold (Stratagene). In some cases, a second XTEN_AE sequence of 144 or 288 amino acids was ligated to the C-terminus of the hGH gene. Transformants were screened by DNA miniprep and the desired construct was confirmed by DNA sequencing. The final vector yields the NTS—XTEN_hGH or NTS—XTEN_hGH_XTEN gene under the control of a T7 promoter.

Example 35

Purification of GH_XTEN Constructs

Protein Expression

The plasmids described above were transformed into BL21 (DE3)-Gold E. coli strain (Novagen) and plated on an LB-agar plate with the appropriate antibiotics and grown overnight at 37° C. A single colony was inoculated into 5 ml of TB 125 medium and grown overnight at 37° C. The next day the inoculum was transformed into a 2 L vessel with 500 ml of TB 125, and grown until an OD=0.6 was reached, followed by continued growth at 26° C. for 16 hr with 0.1 mM IPTG.

Cells were collected by centrifugation and the cell pellet was resuspended in 50 ml Buffer containing 5 mM Tris pH=8.0, 100 mM NaCl. Cells were disrupted using an ultrasonic sonicator cell disruptor, and cell debris was removed by centrifugation at 15000 RPM at 4° C. The pH of the lysate was then adjusted to pH 4.5 with acetic acid to precipitate contaminating host cell proteins and was subsequently clarified by centrifugation. The clarified, acid-treated lysate was then applied to a DE52 Anion exchange chromatography column and eluted with NaCl. The eluted fraction was then further acidified to pH 4.0 and applied to a MacroCapSP cation exchange chromatography column. Product was eluted using sequential elution with NaCl.

Protein purity was estimated to be above 98%. The quantity of eluted fusion protein was determined by SDS-PAGE analysis and by measurement of total protein concentration. A high quantity of eluted fusion protein reflects higher solubility of the fusion protein relative to hGH alone.

Final Formulation and Storage

The buffer exchanged proteins were then concentrated using 10K MWCO Ultrafree concentrator to a final volume of 2 mL. The concentrate was sterile filtered using a 0.22 um syringe filter. The final solution was aliquoted and stored at −80° C.

Example 36

ELISA-Based Binding Assays

Figure 30:
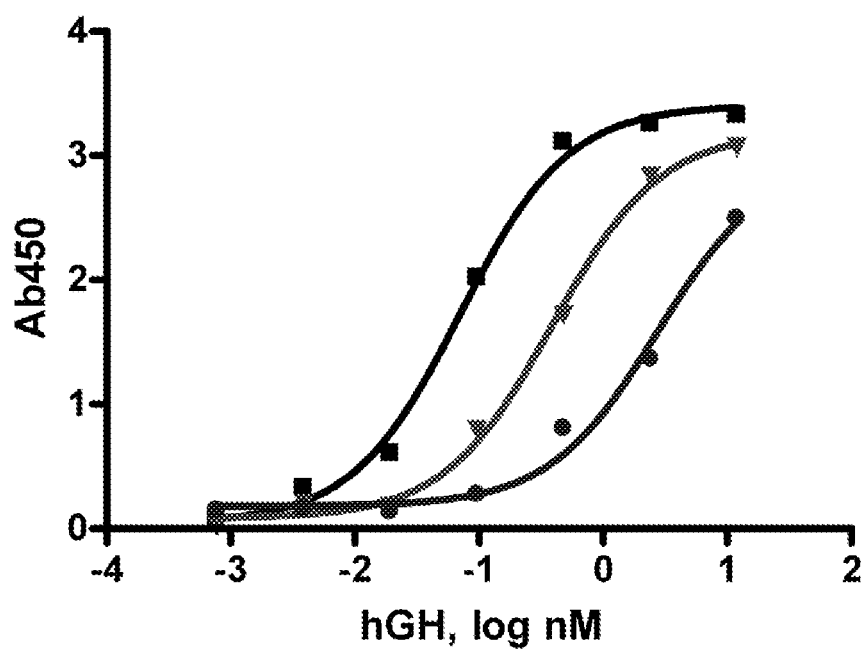
FIG. 30 shows the results of in vitro binding affinity assay of hGH-AM864 (circles) and AM864-hGH (inverted triangles) to hGHR-Fc. Unmodified recombinant hGH (squares) is shown for comparison.
Figure 31:
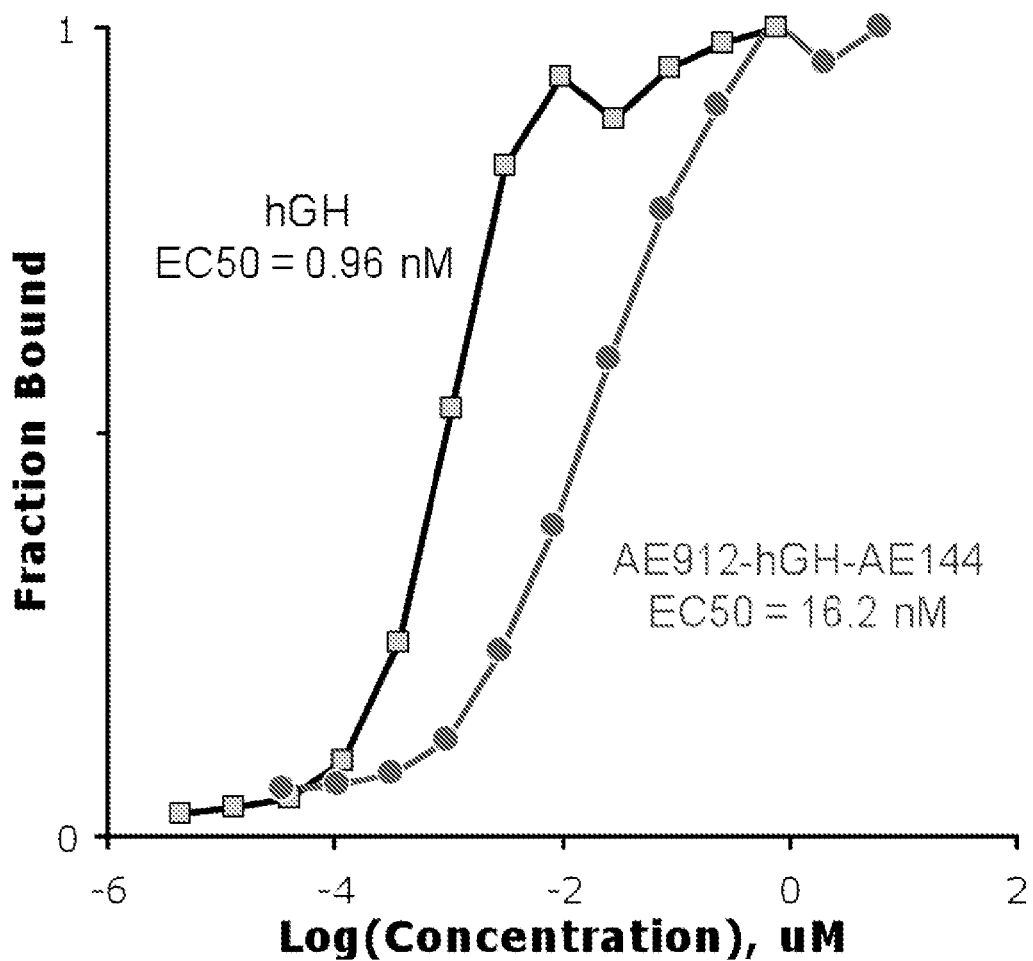
FIG. 31 shows the results of in vitro binding affinity assay of a growth hormone fusion protein with XTEN sequences linked to the N- and C-terminus of the hGH, compared to unmodified hGH, binding to hGHR-Fc. The apparent EC50 values for each compound are listed for the AE912_hGH_AE144 (circles) and unmodified recombinant hGH (squares).

XTEN fusions to GH were tested in a standard ELISA-based assay to evaluate their ability to bind to GH Receptor. Assays were performed using a sandwich ELISA format in which a recombinant hGH receptor (hGHR-Fc) is coated onto wells of an ELISA plate. The wells were then blocked, washed, and BPXTEN samples are then incubated in the wells at varying dilutions to allow capture of the BPXTEN. Wells were washed extensively, and bound protein was detected using a biotinylated preparation of a polyclonal or monoclonal anti-GH or anti-XTEN antibody and streptavidin HRP. The fraction of bound protein can be calculated by comparing the colorimetric response at each serum dilution to a standard curve of unmodified GH. The results, shown in FIG. 30, indicate apparent EC50 values for native hGH of 0.0701 nM, AM864_hGH of 0.3905, and hGH_AM864 of 2.733.

Conclusions:

The results show that the XTEN fusions retain a significant amount of receptor binding activity after fusion, with the BPXTEN fusion protein having the hGH on the C-terminus retaining more binding affinity, compared to the fusion protein having the hGH on the N-terminus.

Example 37

PK Analysis of hGH XTEN Fusion Polypeptides in Rats

The BPXTEN fusion proteins AE912-hGH, AM864-hGH (synonym to AM875-hGH for this and following Examples), AE912-hGH-AE144 and AE912-hGH-AE288 were evaluated in rats in order to determine in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package.

Figure 32:
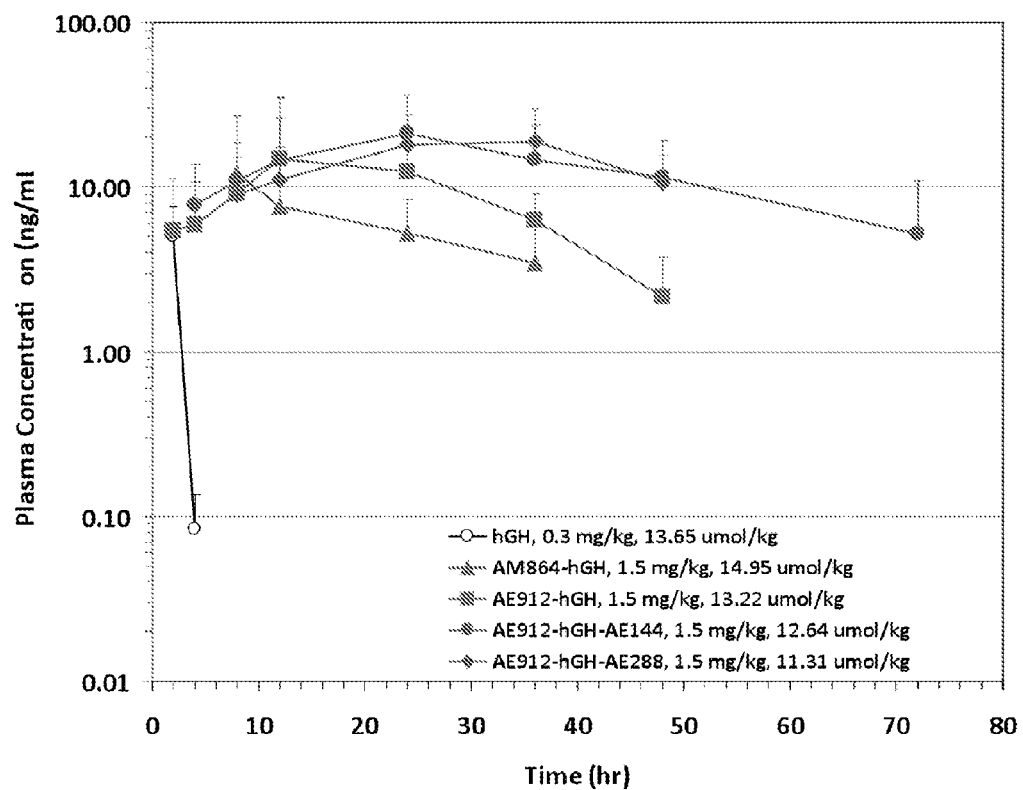
FIG. 32 shows the pharmacokinetic results of four hGH BTXEN fusion proteins administered to rats by the subcutaneous route, compared to unmodified recombinant hGH.

FIG. 32 shows the concentration profiles of the four hGH XTEN constructs after subcutaneous administration. The calculated terminal half-life for AE912-hGH was 7.5 h, 6.8 h for AM864-hGH (synonym to AM875-hGH), 12.4 h for AE912-hGH-AE144 and 13.1 h for AE912-hGH-AE288. For comparison, unmodified hGH was run in parallel in the same experiment and showed a dramatically shorter plasma half-life.

Conclusions:

The incorporation of different XTEN sequences into fusion proteins comprising hGH results in significant enhancement of pharmacokinetic parameters for all four compositions compared to unmodified hGH, as demonstrated in the rodent model, demonstrating the utility of such fusion protein compositions. The addition of a second XTEN protein to the C-terminus of the AE-hGH constructs results in a further enhancement of the terminal half-life compared to the constructs with a single XTEN; likely due to reduced receptor mediated clearance.

Example 38

PK Analysis of hGH XTEN Fusion Polypeptides in Cynomolgus

BPXTEN fusion proteins containing one or two XTEN molecules (AE912-hGH, AM864-hGH, and AE912-hGH-AE144) were evaluated in cynomolgus monkeys in order to determine the effect of the inclusion of a second XTEN on in vivo pharmacokinetic parameters of the hGHXTEN polypeptides. All compositions were provided in an aqueous buffer and were administered by subcutaneous (SC) route into separate animals using 1.5 mg/kg single doses. Plasma samples were collected at various time points following administration and analyzed for concentrations of the test articles. Analysis was performed using a sandwich ELISA format. Recombinant hGHR-Fc was coated onto wells of an ELISA plate. The wells were blocked, washed and plasma samples were then incubated in the wells at varying dilutions to allow capture of the compound by the coated antibodies. Wells were washed extensively, and bound protein was detected using a biotinylated preparation of the polyclonal anti hGH antibody and streptavidin HRP. Concentrations of test article were calculated at each time point by comparing the colorimetric response at each serum dilution to a standard curve. Pharmacokinetic parameters were calculated using the WinNonLin software package. The average terminal half-life for the fusion proteins were 33 h for AM864-hGH, 44 h for AE912-hGH, and 110 h for the AE912-hGH-AE144 (containing two XTEN linked to the N- and C-termini of hGH).

Figure 33:
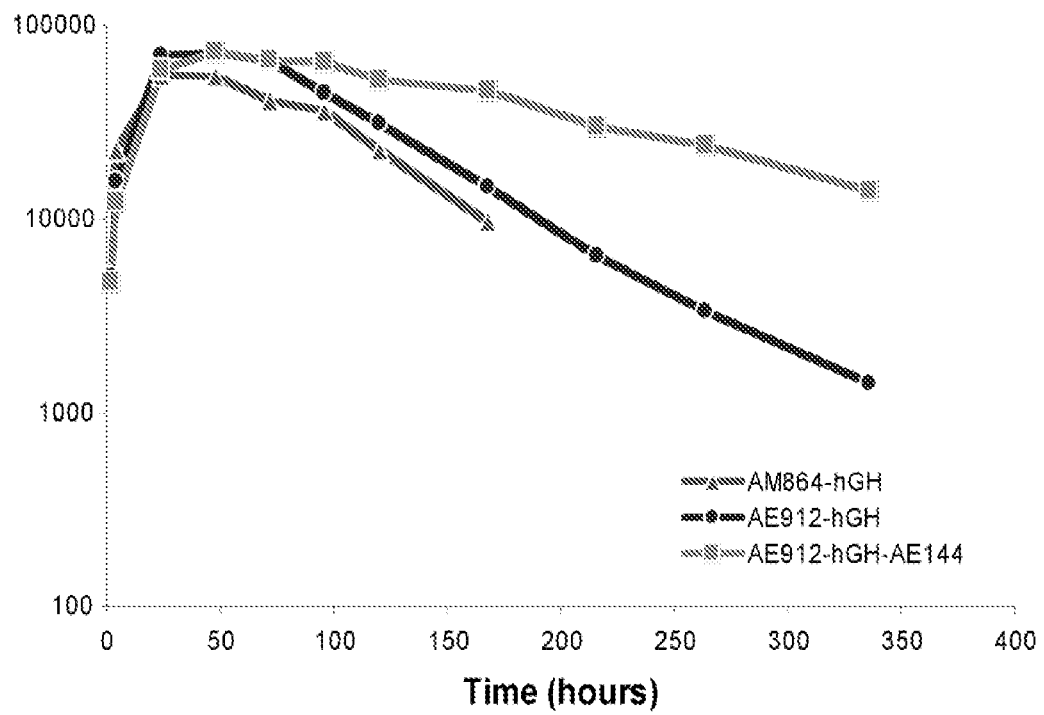
FIG. 33 shows the concentration profiles of three hGH XTEN constructs after subcutaneous administration to cynomolgus monkeys.

FIG. 33 shows the concentration profiles of the three hGH XTEN constructs after subcutaneous administration, and calculated PK parameters are shown. Following subcutaneous administration, the terminal half-life was calculated to be approximately 33-110 hours for the various preparations over the 336 h period.

Conclusions:

The incorporation of different XTEN sequences into fusion proteins comprising hGH results in significant enhancement of pharmacokinetic parameters for all three compositions, as demonstrated in the cyno model, demonstrating the utility of such fusion protein compositions, with the construct containing a second XTEN linked to the C-terminus of the hGH showing a two-fold enhancement of the terminal half-life.

Example 39

Comparative Effects of hGH and AM864-hGH on Body Weight Gain

Figure 34:
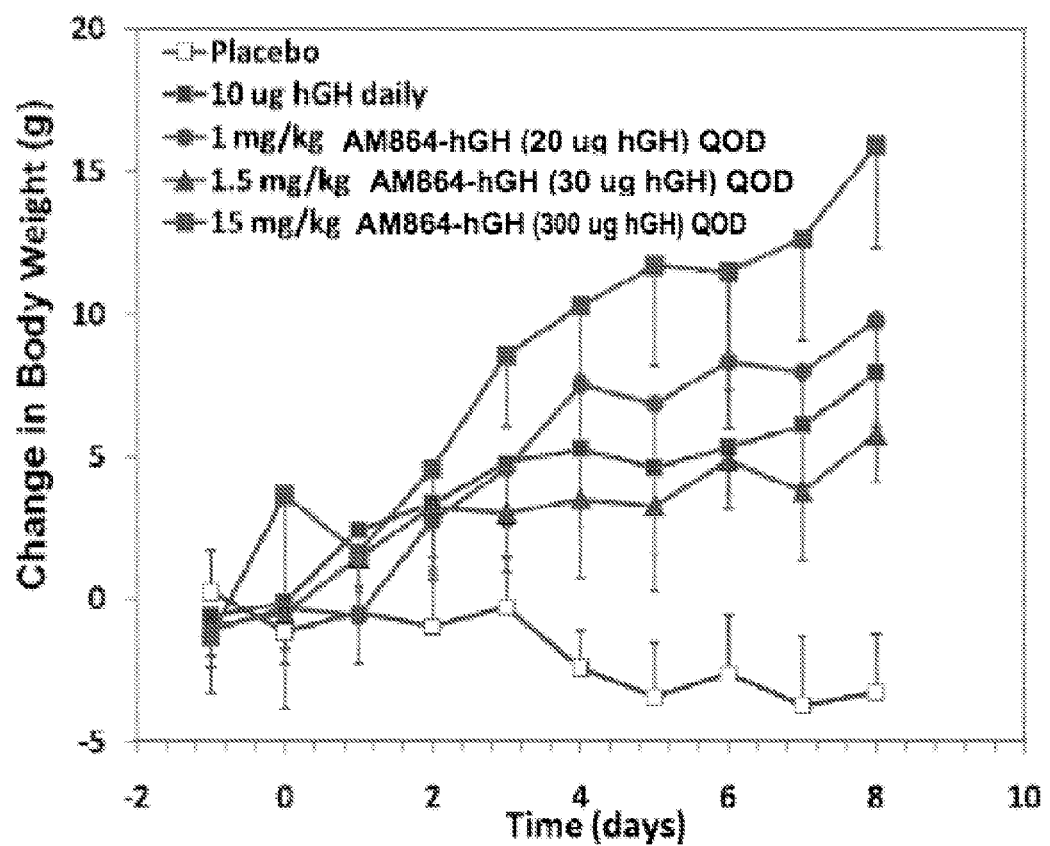
FIG. 34 shows the effects of administration of hGH or AM864-hGH at the indicated doses on body weight in a hypox rat model. The results show retention of biologic activity by the BPXTEN constructs that is equivalent in potency to hGH, yet with less frequent dosing.

The ability of the BPXTEN AM864-hGH to retain pharmacologic potency was assessed using the measured parameter of body weight gain in a hypox rat in response to administered compound. FIG. 34 shows the effects of administration of hGH or AM864-hGH at the indicated doses and dose frequency on body weight in hypox rats. The results show retention of biologic activity by the BPXTEN constructs that is equivalent in potency to a comparable dosage of hGH, yet with less frequent dosing. Increased dose levels of AM864-hGH led to increases in body weight gains over the period of the experiment.

Example 40

Comparative Effects of hGH and AM864-hGH on Bone Cartilage

The ability of a BPXTEN of AM864 linked to hGH to retain pharmacologic potency was assessed using the measured parameter of increase in tibial epiphyseal plate width in hypox rats. FIG. 35 shows the comparative effects of administration of placebo, hGH, and AM864-hGH, shown in histologic cross-sections of the tibia from rats after 9 days of treatment, with the margins denoted with dotted lines. Groups are the same as shown in FIG. 35. FIG. 35A shows that the placebo group had an average cross-section width of 344±38.6 µm of the plate after 9 days. FIG. 35B shows that the hGH group (10 µg daily) had an average cross-section width of 598±8.5 µm after 9 days. FIG. 35C shows that the AM864-hGH (15 mg/kg q3d) had an average cross-section width of 944±8.5 µm after 9 days. The results show enhanced activity by the GHUPR construct, despite being dosed at less frequent intervals.

Example 41

C-Terminal XTEN Releaseable by FXIa

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site cleavage sequence can be incorporated into the FIX-XTEN that contains an amino acid sequence that is recognized and cleaved by the FXIa protease (EC 3.4.21.27, Uniprot P03951). Specifically the amino acid sequence KLTR↓VVGG (SEQ ID NO: 224) [Rawlings N. D., et al. (2008) *Nucleic Acids Res.*, 36: D320], would be cut after the arginine of the sequence by FXIa protease. FXI is the pro-coagulant protease located immediately before FIX in the intrinsic or contact activated coagulation pathway. Active FXIa is produced from FXI by proteolytic cleavage of the zymogen by FXIIa. Once activated, its natural role in coagulation is to activate FIX by excising a peptide from zymogen by cutting the protein at positions R191 and R226 of FIX, which then perpetuates the coagulation pathway. Production of FXIa is tightly controlled and only occurs when coagulation is necessary for proper hemostasis. Therefore, by incorporation of the cleavage sequence, the XTEN domain would only be removed from FIX concurrent with activation of the intrinsic coagulation pathway and when coagulation is required physiologically. This creates a situation where the FIX-XTEN fusion protein would be processed in one additional manner during the activation of the intrinsic pathway. In addition to the natural cleavages that occur at R191 and R226 of the FIX domain by FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 42

C-Terminal XTEN Releaseable by FXIIa

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the XTEN release site sequence can contain an amino acid sequence that is recognized and cleaved by the FXIIa protease (EC 3.4.21.38, Uniprot P00748). Specifically the sequence TMTR↓IVGG (SEQ ID NO: 225) would be cut after the arginine at position 4 of the sequence. FXII is a pro-coagulant protease located before FIX in the intrinsic or contact activated coagulation pathway. Active FXIIa is produced from FXII by contact with non-self surfaces and by cleavage by kallikrein. Once activated its natural role in coagulation is to activate FXI by proteolytic cleavage of the zymogen, which then in turn, perpetuates the coagulation pathway. Production of FXIIa is tightly controlled and only occurs when coagulation is necessary for proper hemostasis. Therefore, by incorporation of the cleavage sequence, the XTEN domain would only be removed from FIX concurrent with activation of the intrinsic coagulation pathway and when coagulation is required physiologically. This creates a situation where FIX-XTEN fusion would be processed in one additional manner during the activation of the intrinsic pathway. In addition to the natural cleavages that occur at R191 and R226 of the FIX domain by FXIa, a third cleavage would occur at the XTEN release site that would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 43

C-Terminal XTEN Releaseable by Kallikrein

Figure 39:
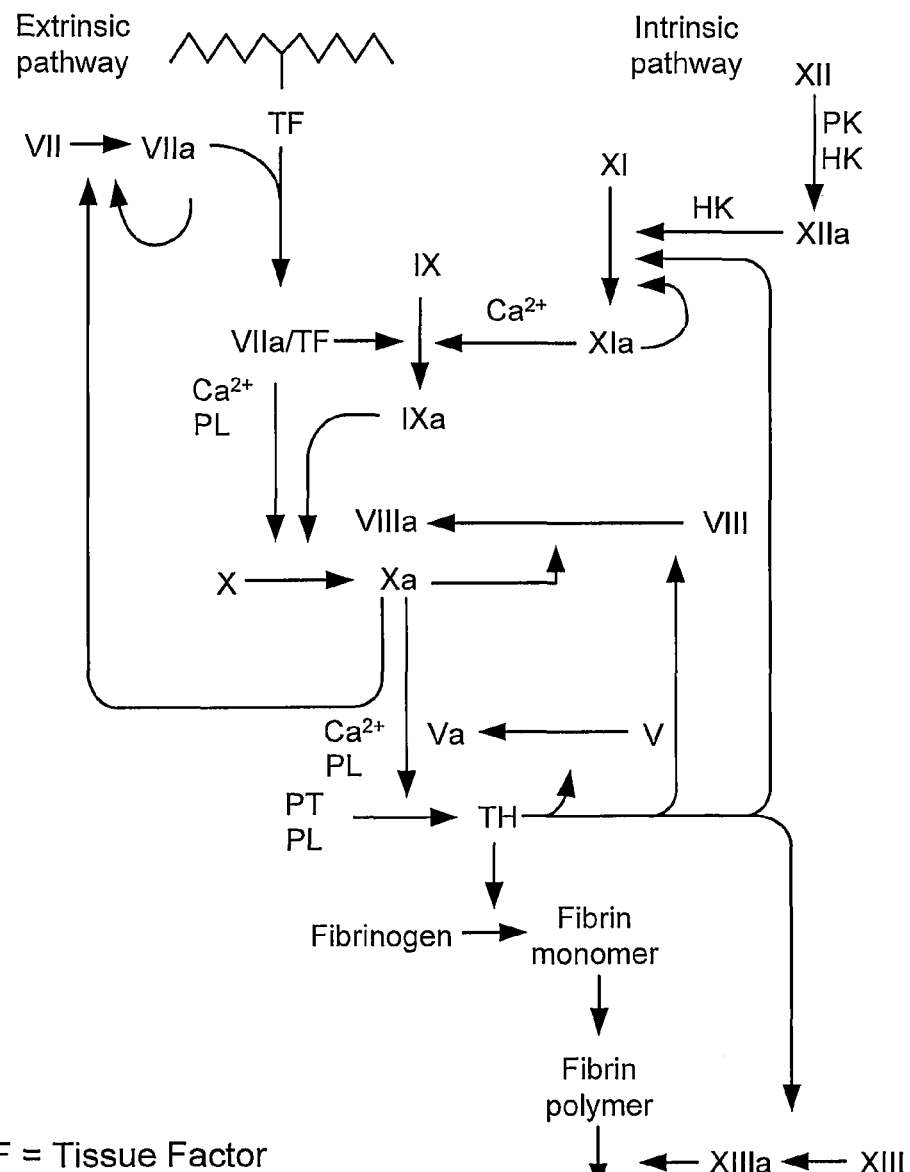
FIG. 39 is a schematic of the coagulation cascade, showing both the extrinsic and intrinsic pathways.

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the XTEN release site sequence can an amino acid sequence that is recognized and cleaved by the kallikrein protease (EC 3.4.21.34, Uniprot P03952). Specifically the sequence SPFR↓STGG (SEQ ID NO: 226) [Rawlings N. D., et al. (2008) *Nucleic Acids Res.*, 36: D320], would be cut after the arginine at position 4 of the sequence. Kallikrein is a procoagulant protease located before FIX in the intrinsic or contact activated coagulation pathway. Active Kallikrein is produced from Plasma Kallirien by contact with non-self surfaces. Once activated its natural role in coagulation is to activate FXII (FIG. 39) by proteolytic cleavage of the zymogen, which then in turn, perpetuates the coagulation pathway. Production of kallikrien is tightly controlled and only occurs when coagulation is necessary for proper hemostasis. Therefore, by incorporation of the cleavage sequence the XTEN domain would only be removed from FIX concurrent with activation of the intrinsic coagulation pathway and when coagulation is required physiologically. This creates a situation where FIX-XTEN fusion would be processed in one additional manner during the activation of the intrinsic pathway. In addition to the natural cleavages that occur at R191 and R226 of the FIX domain by FXIa, a third cleavage would occur at the XTEN release site that would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 44

C-Terminal XTEN Releaseable by FVIIa

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site sequence contains an amino acid sequence that is recognized and cleaved by the FVIIa protease (EC 3.4.21.21, Uniprot P08709). Specifically the sequence LQVR↓IVGG (SEQ ID NO: 227) [Rawlings N. D., et al. (2008) *Nucleic Acids Res.*, 36: D320], would be cut after the arginine at position 4 in the sequence. FVIIa is a pro-coagulant protease located before FIX in the extrinsic or cellular injury activated coagulation pathway. Active FVIIa is produced from FVII in an autocatalytic process aided by binding to tissue factor, phospholipids and calcium. Once activated its natural role in coagulation is to activate FIX and FX (FIG. 39) by proteolytic cleavage of the zymogens, which then in turn, perpetuate the coagulation pathway. FVIIa activity is tightly controlled and only occurs when coagulation is necessary for proper hemostasis. Therefore, by incorporation of the cleavage sequence the XTEN domain would only be removed from FIX concurrent with activation of the intrinsic coagulation pathway and when coagulation is required physiologically. This creates a situation where FIX-XTEN fusion would be processed in one additional manner during the activation of the intrinsic pathway. In addition to the natural cleavages that would occur at R191 and R226 of the FIX domain by FVIIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 45

C-Terminal XTEN Releaseable by FIXa

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site cleavage sequence contains an amino acid sequence that is recognized and cleaved by the FIXa protease (EC 3.4.21.22, Uniprot P00740). Specifically the sequence PLGR↓IVGG (SEQ ID NO: 228) [Rawlings N. D., et al. (2008) *Nucleic Acids Res.*, 36: D320], would be cut after the arginine at position 4 of the sequence. Active FIXa is produced by cleavage of FIX by either FXIa or FVIIa in the presence of phospholipids and calcium. Once activated its natural role in coagulation is to activate FX (FIG. 39) by proteolytic cleavage of the zymogen, which then in turn, perpetuates the coagulation pathway. FIXa activity is tightly controlled and only occurs when coagulation is necessary for proper hemostasis. Therefore, by incorporation of the cleavage sequence, the XTEN domain would only be removed from FIX concurrent with activation of either the extrinsic or intrinsic coagulation pathways, and when coagulation is required physiologically. This creates a situation where FIX-XTEN fusion would be processed in one additional manner during the activation of the intrinsic pathway. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 46

C-Terminal XTEN Releaseable by FXa

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the FXa protease (EC 3.4.21.6, Uniprot P00742). Specifically the sequence IEGR↓TVGG (SEQ ID NO: 229) [Rawlings N. D., et al. (2008) *Nucleic Acids Res.*, 36: D320], would be cut after the arginine at position 4 in the sequence. Active FXa is produced by cleavage of FX by FIXa in the presence of phospholipids and calcium and is the step immediately down stream from factor IX in the coagulation pathway. Once activated its natural role in coagulation is to activate FII (FIG. 39) by proteolytic cleavage of the zymogen, which then in turn, perpetuates the coagulation pathway. FXa activity is tightly controlled and only occurs when coagulation is necessary for proper hemostasis. Therefore, by incorporation of the cleavage sequence, the XTEN domain would only be removed from FIX concurrent with activation of either the extrinsic or intrinsic coagulation pathways, and when coagulation is required physiologically. This creates a situation where FIX-XTEN fusion would be processed in one additional manner during the activation of clotting. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 47

C-Terminal XTEN Releaseable by FIIa (Thrombin)

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the FIIa protease (EC 3.4.21.5, Uniprot P00734). Specifically the sequence LTPR↓SLLV (SEQ ID NO: 230) [Rawlings N. D., et al. (2008) *Nucleic Acids Res.,* 36: D320], would be cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibringin (FIG. 39), which then in turn, begins clot formation. FIIa activity is tightly controlled and only occurs when coagulation is necessary for proper hemostasis. Therefore, by incorporation of the cleavage sequence, the XTEN domain would only be removed from FIX concurrent with activation of either the extrinsic or intrinsic coagulation pathways, and when coagulation is required physiologically. This creates a situation where FIX-XTEN fusion would be processed in one additional manner during the activation of coagulation. In addition to the natural cleavages that would occur at R191 and R226 of the FIX domain by FVIIa or FXIa, a third cleavage would occur at the XTEN release site which would decouple the now activated FIXa from the XTEN protein. In a desirable feature of the inventive composition, this creates a situation where FIX-XTEN would remain intact as a pro-drug until activation of coagulation, at which time the molecule would be processed to produce free FIXa which reconstitutes or augments clotting function in a subject in need thereof.

Example 48

C-Terminal XTEN Releaseable by Elastase-2

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the elastase-2 protease (EC 3.4.21.37, Uniprot P08246). Specifically the sequence LGPV↓SGVP (SEQ ID NO: 231) [Rawlings N. D., et al. (2008) *Nucleic Acids Res.,* 36: D320], would be cut after position 4 in the sequence. Elastase is constitutively expressed by neutrophils and is present at all times in the circulation. Its activity is tightly controlled by serpins and is therefore minimally active most of the time. Therefore as the long-lived FIX-XTEN circulates, a fraction of it would be cleaved, creating a pool of shorter-lived FIX to be used in coagulation. In a desirable feature of the inventive composition, this creates a circulating pro-drug depot that constantly releases a prophylactic amount of FIX.

Example 49

C-Terminal XTEN Releaseable by MMP-12

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the MMP-12 protease (EC 3.4.24.65, Uniprot P39900). Specifically the sequence GPAG↓LGGA (SEQ ID NO: 233) [Rawlings N. D., et al. (2008) *Nucleic Acids Res.,* 36: D320], would be cut after position 4 of the sequence. MMP-12 is constitutively expressed in whole blood. Therefore as the long-lived FIX-XTEN circulates, a fraction of it would be cleaved, creating a pool of shorter-lived FIX to be used in coagulation. In a desirable feature of the inventive composition, this creates a circulating pro-drug depot that constantly releases a prophylactic amount of FIX.

Example 50

C-Terminal XTEN Releaseable by MMP-13

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the MMP-13 protease (EC 3.4.24.-, Uniprot P45452). Specifically the sequence GPAG↓LRGA (SEQ ID NO: 234) [Rawlings N. D., et al. (2008) *Nucleic Acids Res.,* 36: D320], would be cut after position 4 (depicted by the arrow). MMP-13 is constitutively expressed in whole blood. Therefore as the long-lived FIX-XTEN circulates, a fraction of it would be cleaved, creating a pool of shorter-lived FIX to be used in coagulation. In a desirable feature of the inventive composition, this creates a circulating pro-drug depot that constantly releases a prophylactic amount of FIX.

Example 51

C-Terminal XTEN Releaseable by MMP-17

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the MMP-20 protease (EC.3.4.24.-, Uniprot Q9ULZ9). Specifically the sequence APLG↓LRLR (SEQ ID NO: 235) [Rawlings N. D., et al. (2008) *Nucleic Acids Res.,* 36: D320], would be cut after position 4 in the sequence. MMP-17 is constitutively expressed in whole blood. Therefore as the long-lived FIX-XTEN circulates, a fraction of it would be cleaved, creating a pool of shorter-lived FIX to be used in coagulation. In a desirable feature of the inventive composition, this creates a circulating pro-drug depot that constantly releases a prophylactic amount of FIX.

Example 52

C-Terminal XTEN Releaseable by MMP-20

An FIX-XTEN fusion protein consisting of an XTEN protein fused to the C-terminus of FIX can be created with a XTEN release site cleavage sequence placed in between the FIX and XTEN components, as depicted in FIG. 36B. Exemplary sequences are provided in Table 43. In this case, the release site contains an amino acid sequence that is recognized and cleaved by the MMP-20 protease (EC.3.4.24.-, Uniprot O60882). Specifically the sequence PALP↓LVAQ (SEQ ID NO: 236) [Rawlings N. D., et al. (2008) *Nucleic Acids Res.*, 36: D320], would be cut after position 4 (depicted by the arrow). MMP-20 is constitutively expressed in whole blood. Therefore as the long-lived FIX-XTEN circulates, a fraction of it would be cleaved, creating a pool of shorter-lived FIX to be used in coagulation. In a desirable feature of the inventive composition, this creates a circulating pro-drug depot that constantly releases a prophylactic amount of FIX.

Example 53

Internal XTEN Fusion into the KNSADK Loop

An FIX-XTEN fusion protein consisting of an XTEN protein inserted into a loop of FIX can be created, as depicted in FIG. 37F. Specifically, the XTEN sequence would be inserted as a fusion into the KNSADNK (SEQ ID NO: 1749) loop of the EGF2 domain (residues 146-152), which has no known hemophilia B mutations and is not highly structured in the FIX crystal structure. In this case, the insertion would be made by dividing the native sequence at the SA bond of the loop sequence and fusing the XTEN sequence into the gap. This would give rise to a loop sequence wherein the XTEN would be internal to the FIX sequence but exterior to the globular protein. In a desirable feature of the inventive composition, this creates a situation where FIX-XTEN would remain intact as a pro-drug until activation of coagulation, at which time the molecule would be processed to produce FIXa-XTEN, which reconstitutes or augments clotting function in a subject in need thereof.

Example 54

Internal XTEN Fusion into the LAEN Loop

An FIX-XTEN fusion protein consisting of an XTEN protein inserted into a loop of FIX can be created, as depicted in FIG. 37F. Specifically, the XTEN sequence would be inserted as a fusion into the LAEN (SEQ ID NO: 1778) loop of the EGF2 domain (residues 163-166), which has no known hemophilia B mutations and is not highly structured in the FIX crystal structure. In this case, the insertion would be made by dividing the native sequence at the AE bond of the sequence and fusing the XTEN sequence into the gap. This would give rise to a loop sequence LA-XTEN-EN. In a desirable feature of the inventive composition, this creates a situation where FIX-XTEN would remain intact as a pro-drug until activation of coagulation, at which time the molecule would be processed to produce FIXa-XTEN, which reconstitutes or augments clotting function in a subject in need thereof.

Example 55

Internal XTEN Fusion into the Activation Peptide

An FIX-XTEN fusion protein consisting of an XTEN protein inserted into a loop of FIX can be created, as depicted in FIG. 37D. Specifically, the XTEN fusion would be placed into the activation peptide (residues 192-226) such that neither of the two native FXIa cleavage sites would be disrupted. The insertion would be made by dividing the native sequence at the T209-I210 bond (indicated by of the sequence and fusing the XTEN sequence into the gap. This gives rise to a sequence with XTEN inserted starting at residue 188 of the activation peptide. FXI is the pro-coagulant protease located immediately before FIX in the intrinsic or contact activated coagulation pathway. Active FXIa is produced from FXI by proteolytic cleavage of the zymogen by FXIIa. Once activated its natural role in coagulation is to activate FIX (FIG. 39) by excising the activation peptide from the FIX zymogen by cutting the protein at positions R191 and R226. These cuts sites are depicted by arrows and the sequences are designed to leave the P4-P4' sites unaltered to allow for natural cleavage activity during the coagulation cascade. Therefore the XTEN domain would only be removed from FIX as part of the normal activation process within the intrinsic coagulation pathway.

Example 56

Internal XTEN Fusion in Between the FIX EGF Domains

An FIX-XTEN fusion protein consisting of an XTEN protein inserted into a loop of FIX can be created, as depicted in FIG. 37C. Specifically, the XTEN fusion would be placed in between the two EGF like domains of FIX (junction is between residues 129 and 130). The insertion would be made by dividing the native sequence at the E129-L130 bond and fusing the XTEN sequence into the gap. This would give rise to a sequence with XTEN inserted starting at residue 121. Practically, this creates a situation where FIX-XTEN would circulate intact until activation of coagulation, at which time the molecule would be processed to produce FIXa-XTEN, which reconstitutes or augments clotting function in an individual.

Example 57

Optimization of the Release Rate of C-Terminal XTEN

Variants of the foregoing Examples 41-57 can be created in which the release rate of C-terminal XTEN is altered. As the rate of XTEN release by an XTEN release protease is dependent on the sequence of the XTEN release site, by varying the amino acid sequence in the XTEN release site one can control the rate of XTEN release. The sequence specificity of many proteases is well known in the art, and is documented in several databases. In this case, the amino acid specificity of proteases would be mapped using combinatorial libraries of substrates [Harris, J. L., et al. (2000) *Proc Natl Acad Sci USA*, 97: 7754] or by following the cleavage of substrate mixtures as illustrated in [Schellenberger, V., et al. (1993) *Biochemistry*, 32: 4344]. An alternative is the identification of desired protease cleavage sequences by phage display [Matthews, D., et al. (1993) *Science*, 260: 1113]. Constructs would be made with variant sequences and assayed for XTEN release using standard assays for detection of the XTEN polypeptides.

Example 58

Thrombin Activation of FIX-XTEN

An XTEN release site specific for FXI was inserted into FIX-XTEN_AE864, resulting in construct AC299. An XTEN release site specific for thrombin was inserted into FIX-XTEN_AE864 resulting in construct AC300. Construct AC296 that lacks an XTEN release site was used as a control. Expression plasmids were transfected using FuGene6 transfection reagent (Roche) into BHK-21 cells (1.2×10e6 cells in 10 ml of OptiMEM medium from Invitrogen). Medium was harvested after 4 days and concentrated 40-fold using an Amicon Ultra centrifugal filter (Ultracel_30K, Millipore) concentrator. 67 µl of concentrated medium was diluted into 10× thrombin buffer and incubated with 25 µl of immobilized thrombin (Thrombin CleanCleave Kit, RECOM-T, Sigma) for 8 hours at room temperature. The concentration of FIX in all samples was determined by ELISA using antibodies (cat #FIX-EIA, Affinity Biologicals inc. Canada). Clotting activity was determined using an aPPT assay (Thermo Scientific Pacific Hemostasis, Fisher) and activities were converted into concentrations of FIX assuming that 1 mU of FIX is equivalent to 4.5 ng/ml. Results are compiled in Table 31 below. The data show that thrombin incubation had no significant effect on ELISA signal and clotting activity of AC296 and AC299, which is consistent with the fact that both constructs lack a thrombin site. In contrast, thrombin treatment resulted in an 27-fold increase of clotting activity for AC300. Thrombin treatment restored clotting activity of AC300 to 80% of free FIX. These data demonstrate that fusion of XTEN to the C-terminus of FIX resulted in a 50- to 100-fold reduction of clotting activity. Supporting the concept of the pro-drug properties of these C-terminal FIX-XTEN constructs, proteolytic release of XTEN restored most of the clotting activity.

TABLE 31

ELISA and clotting activity of FIX-XTEN fusion proteins.

| | AC296 | AC299 | AC300 |
|---|---|---|---|
| ELISA (ng/ml), no thrombin | 1 | 1 | 1 |
| ELISA (ng/ml), with thrombin | 0.70 | 1.34 | 2.75 |
| Clotting activity (ng/ng), no thrombin | 0.01 | 0.00 | 0.03 |
| Clotting activity (ng/ng), with thrombin | 0.01 | 0.02 | 0.80 |

Example 59

XTEN Insertion into FIX Based on Exon Structure

Figure 40:
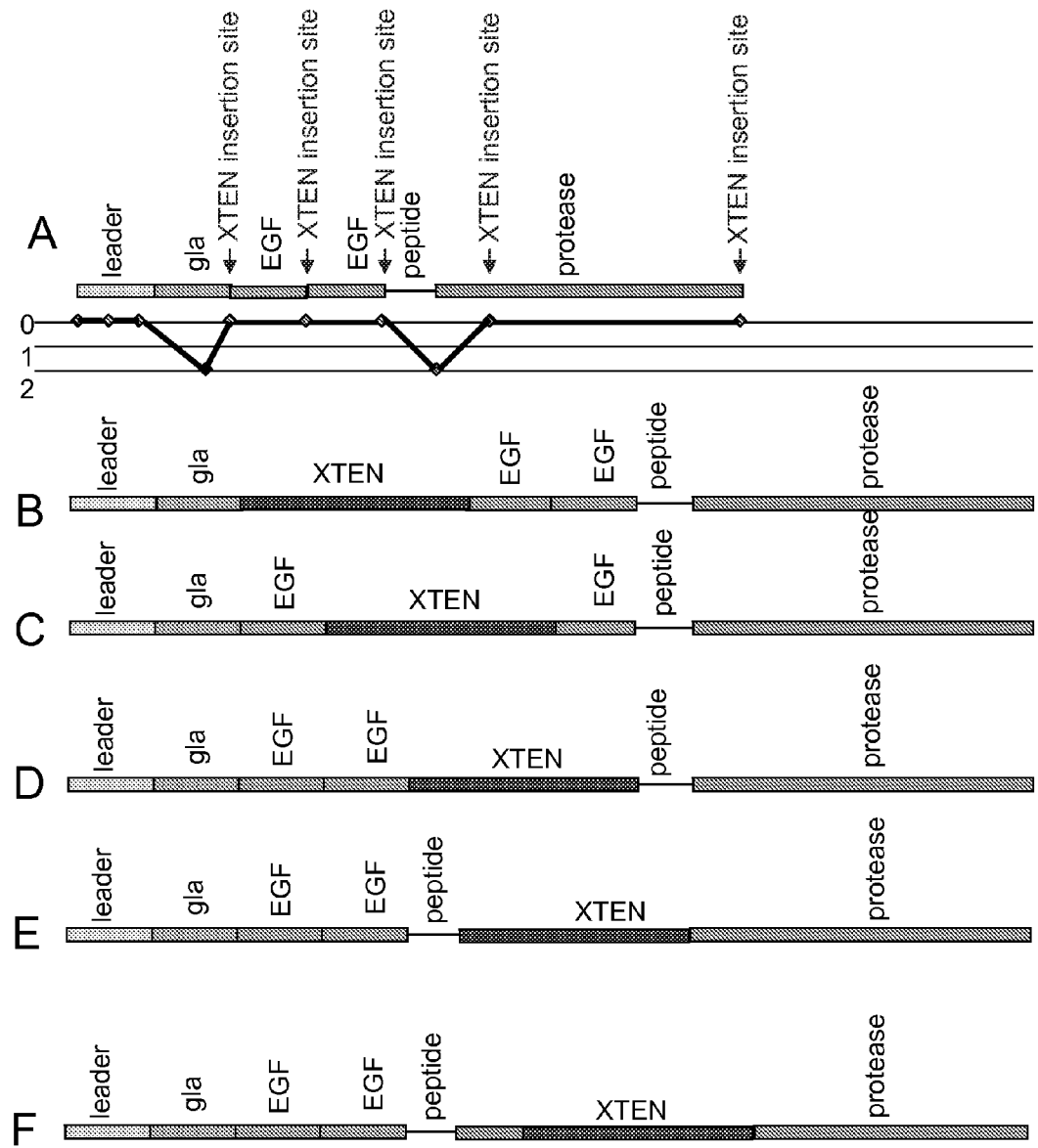
FIG. 40 illustrates a strategy for FIX-XTEN design approach using exon location within the gene encoding FIX, with exemplary sites for XTEN insertion between exon boundaries indicate by arrows.
Figure 41:
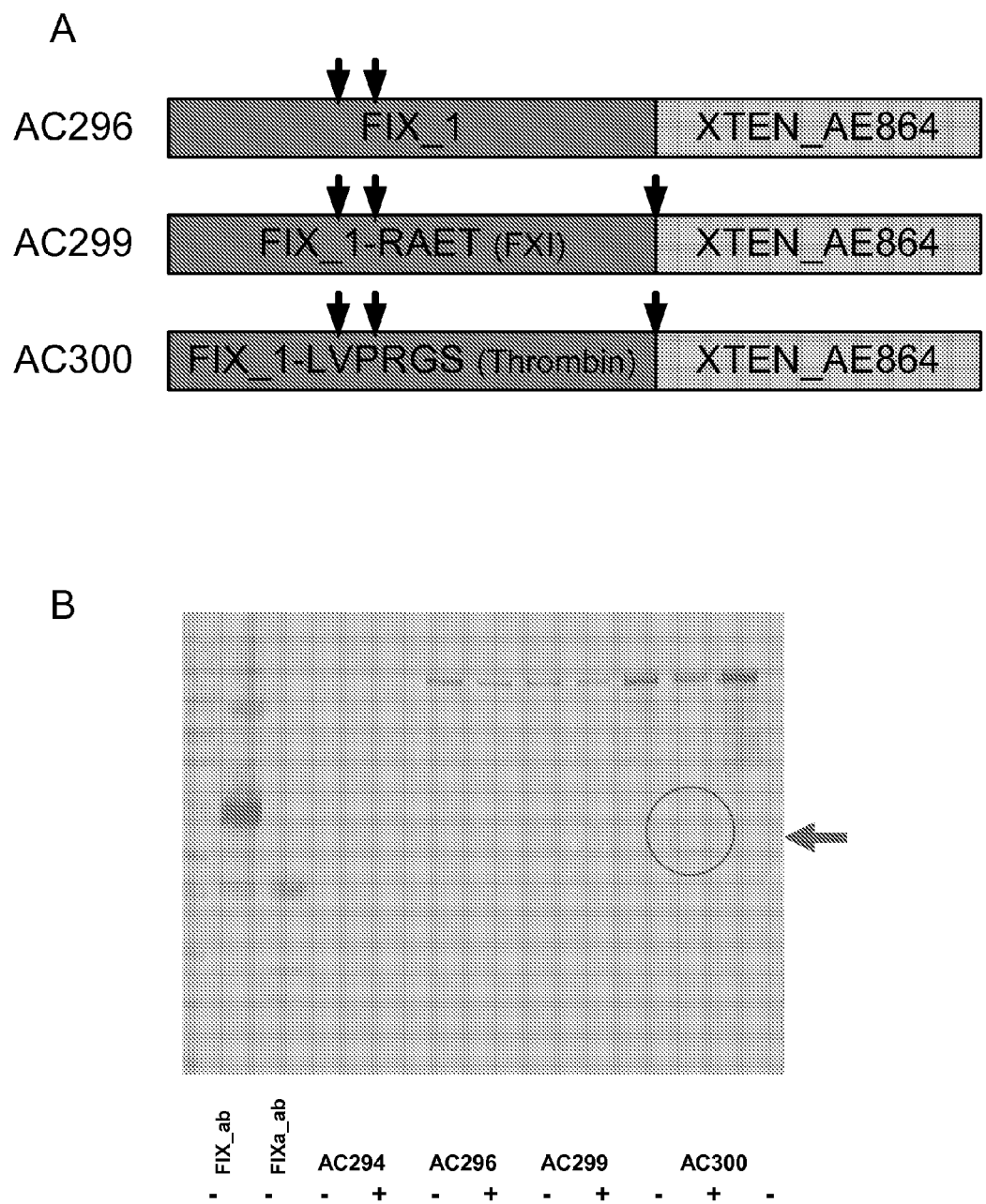
FIG. 41.

The exon structure of proteins provides valuable information about domain boundaries that can guide the insertion of XTEN into mammalian proteins [Kolkman, J. A., et al. (2001) Nat Biotechnol, 19: 423]. FIG. 40 illustrates several examples of how this approach applies to the creation of FIX-XTEN compositions, with exemplary sites for XTEN insertion between exon boundaries indicated.

Example 60

FIX-XTEN Based on Engineered FIX Sequences

Many mutants of FIX have been engineered for improved activity. Of particular utility are mutants with increased protease activity. However, mutants with improvements in Gla and/or EGF domains can be useful as well for the treatment of hemophilia B such that, after experimental or clinical evaluation, they could be used instead of the native FIX sequence. Examples of useful FIX mutants are presented in Table 7.

Example 61

Production of FIX-XTEN

Figure 42:
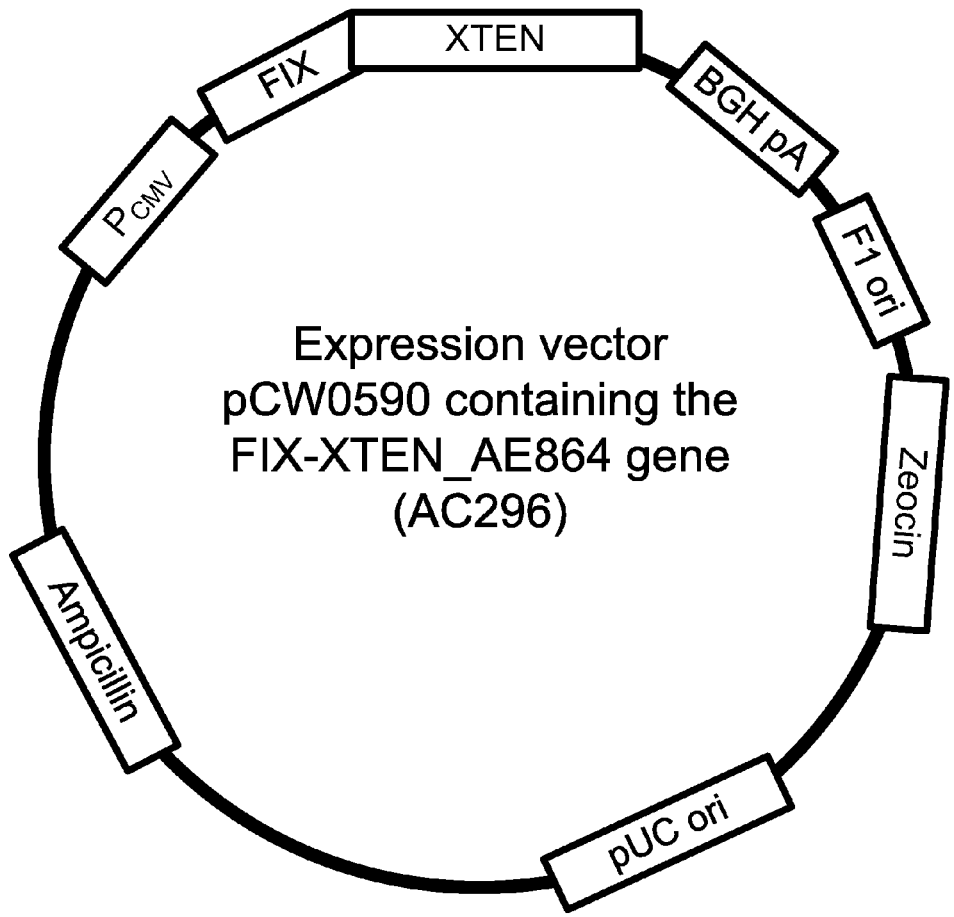
FIG. 42 is a schematic representation of the design of FIX-XTEN expression vector pCW0590 containing the FIX-XTEN gene.
Figure 43:
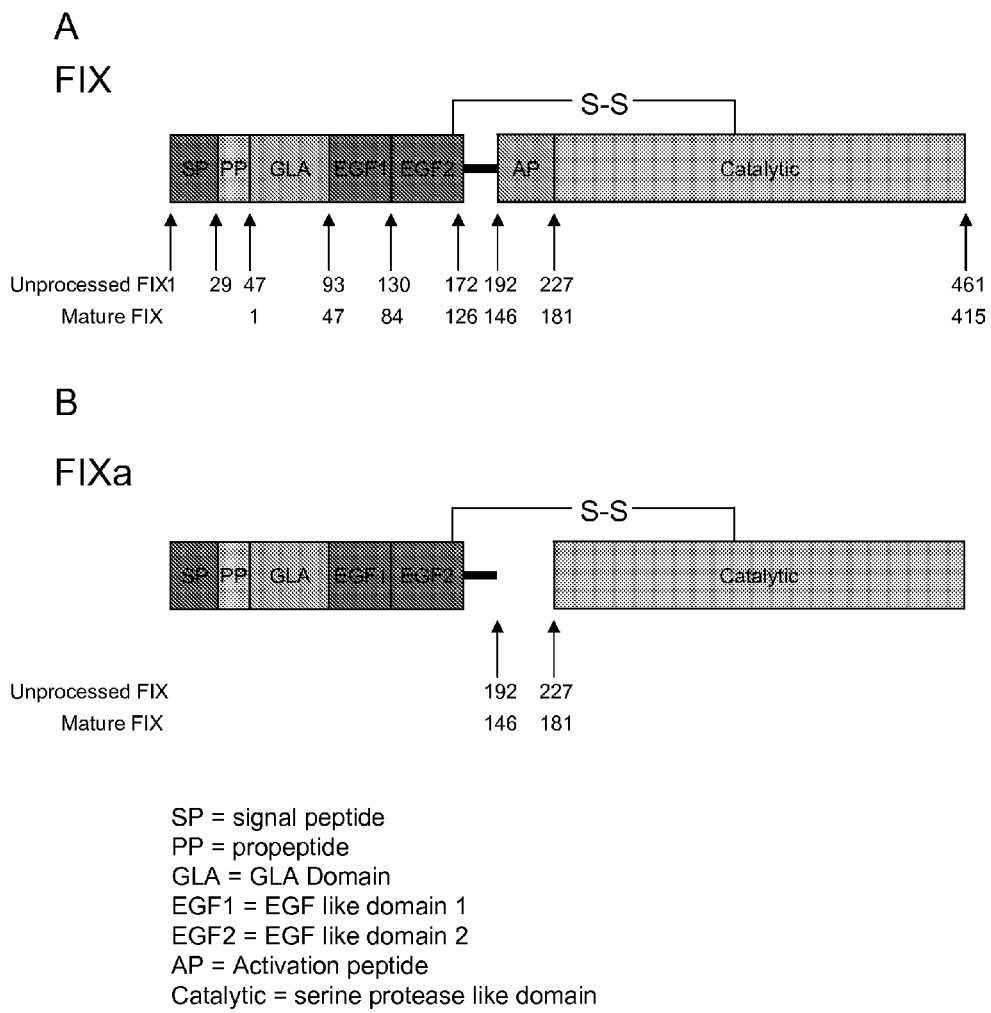
FIG. 43.
Figure 45:
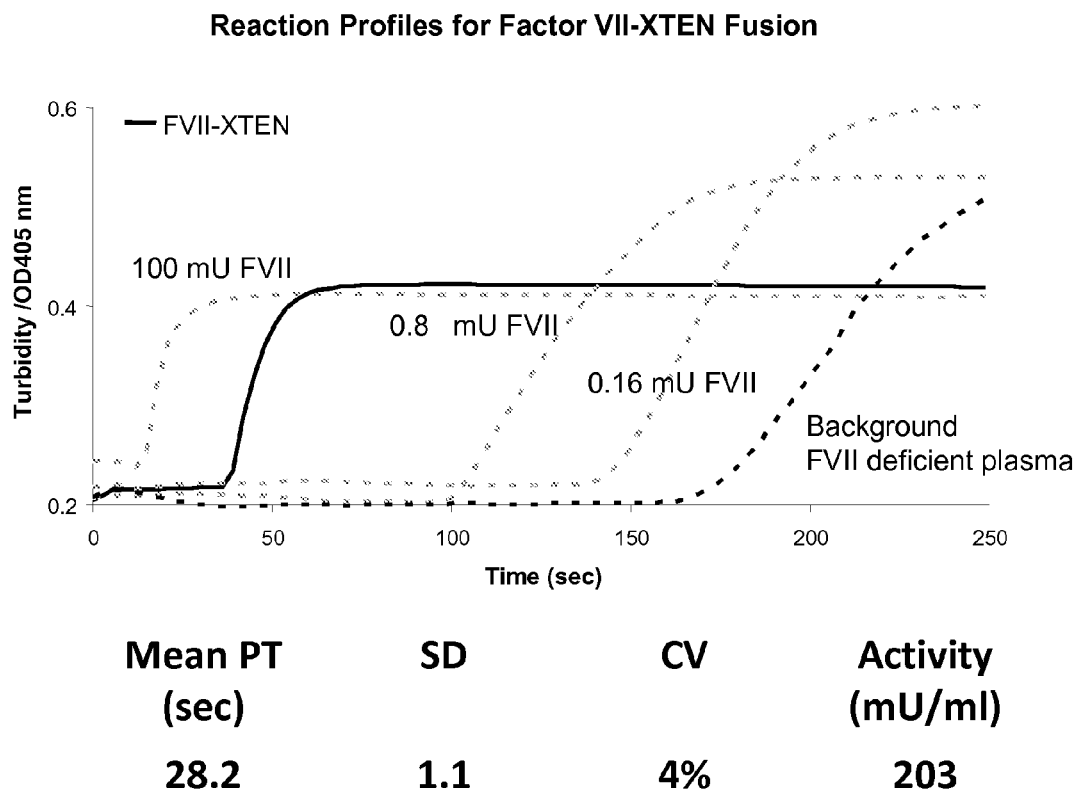
FIG. 45 shows a graph of results of a FVII assay, with reaction profiles for various concentrations of FVII standards and the reaction profile of an FVII-XTEN. Results of the assay for FVII-XTEN are shown in the table below the graph.

FIX-XTEN fusion proteins can be expressed in a variety of mammalian expression vectors. An exemplary vector pCW05090, based on pSecTag2 (Invitrogen) is illustrated in FIG. 42. The expression construct contains an expression cassette comprising the CMV promoter, the signal peptide of FIX, the propeptide of FIX, the mature FIX gene fused to the gene encoding XTEN_AE864, followed by a polyadenylation site. The vector contains a zeosin marker for selection in mammalian cells, a pUC origin of replication for E. coli, and an ampicillin marker for selection in E. coli. The expression vector can be transfected into CHO cells, PER.C6 cells, or BHK cells for expression. Expression can be monitored by ELISA or clotting assay. FIX-XTEN fusion proteins can be purified by ion exchange in particular anion exchange. For purposes of this experiment, it was transfected into CHO cells.

Initial Process Capture by Anion Exchange Chromatography

Cell culture medium from cultures of the transfected cells was directly applied to 800 ml of Macrocap Q anion exchange resin (GE Life Sciences) that had been equilibrated with 20 mM Tris pH 6.8, 50 mM NaCl. The column was sequentially washed with Tris pH 6.8 buffer containing 50 mM, 100 mM, and 150 mM NaCl. The product was eluted with 20 mM Tris pH 6.8, 250 mM NaCl.

Hydrophobic Interaction Chromatography (HIC) Using Octyl Sepharose FF

A 250 mL Octyl Sepharose FF column was equilibrated with equilibration buffer (20 mM Tris pH 6.8, 1.0 M $Na_2SO_4$). Solid $Na_2SO_4$ was added to the Macrocap Q eluate pool to achieve a final concentration of 1.0 M. The resultant solution was filtered (0.22 micron) and loaded onto the HIC column. The column was then washed with equilibration buffer for 10 CV to remove unbound protein and host cell DNA. The product was then eluted with 20 mM Tris pH 6.8, 0.5 M $Na_2SO_4$.

Product Polishing by Anion Exchange Chromatography

The pooled HIC eluate fractions were then diluted with 20 mM Tris pH 7.5 to achieve a conductivity of less than 5.0 mOhms. The dilute product was loaded onto a 300 ml Q Sepharose FF anion exchange column that had been equilibrated with 20 mM Tris pH 7.5, 50 mM NaCl.

Final Formulation and Storage

The buffer exchanged proteins were then concentrated by ultrafiltration/diafiltration (UF/DF), using a Pellicon XL Biomax 30000 mwco cartridge, to greater than 30 mg/ml. The concentrate was sterile filtered using a 0.22 micron syringe filter. The final solution was aliquoted and stored at −80° C.

Example 62

Codon Optimization of FIX-XTEN

Codon optimization can be applied to increase expression of FIX-XTEN. This can be performed using computer algo-

Example 63

Depot Formulations of FIX-XTEN

XTEN can be chosen with particular properties for formulation to form depots at the injection site. This would result in slow release of FIX-XTEN from the injection site and increase the time between dosing intervals. Depot formation can be facilitated by formulating FIX-XTEN with excipients that interact with FIX-XTEN and result in complex or aggregate formation. Examples of useful excipients are zinc, protamine, PEG, polycations, polymers, polyarginine, polylysine. Depots can also be formed by loading FIX-XTEN into particles such as alginate, chitin, polylactic acid, PLGA, hyaluronic acid, hydroxyapatite or other polymers known to one of skill in the art.

Example 64

FIX-XTEN with Increased Stability

Free FIX is prone to aggregation, which complicates formulation of the protein. This characteristic also prevents the development of high-concentration formulations that allow small injection volumes required for sc injection. Because of the properties of XTEN in reducing aggregation of fusion partners, compositions of FIX-XTEN can be created that 1) prevent FIX from aggregating; and 2) permit subcutaneous or intramuscular administration.

Example 65

FVII-XTEN_AE864

The gene encoding factor VII ("FVII") was fused in frame to XTEN_AE864 and inserted into expression vector pCW0590. CHO-K1 cells were transfected with the expression vector and stable pools were selected using zeocin, and expressed protein was recovered. The amino acid sequence for the expressed Factor VII-XTEN_AE864 is listed in Table 43. Expression levels of 159 ng/ml of FVII equivalent were detected by ELISA and 214 ng/ml of FVII equivalent were detected using a PPT clotting assay (Thermo Scientific Pacific Hemostasis, Fisher). This demonstrates that fusion of XTEN_AE864 to FVII to create the BPXTEN results in a fusion protein that retains the clotting activity of FVII.

Example 66

Manufacturing of FVIIa-XTEN

FVIIa-XTEN can be manufactured essentially as described in Example 61 for FIX-XTEN. An activation step would be added to convert FVII-XTEN into FVIIa-XTEN. Alternatively, a bicistronic vector could be utilized such that both protein chains of FVIIa are expressed separately and assemble directly into activated FVIIa-XTEN.

Example 67

Factor VII—Assessing the Activity of FVII-XTEN Fusions Polypeptides

A standard curve was prepared by diluting normal control plasma (Pacific Hemostasis 100595) ten fold with FVII deficient plasma (100070) and then conducting 4, 5 fold serial dilutions again with factor VII deficient plasma. This created a standard curve with points at 100, 20, 4, 0.8 and 0.16 mUnits/ml of activity, where one unit of activity is defined as the amount of FVII activity in 1 ml of normal human plasma. A FVII-deficient plasma was also included to determine the background level of activity in the null plasma. The sample was prepared by adding FVII-XTEN secreted by HEK293 cells that were transiently transfected with a vector containing FVII-XTEN coding sequence in conditioned media from the cell growth, to FVII deficient plasma at a ratio of 1:10 by volume. To compensate for possible interference from the conditioned media, conditioned media from a HEK293 cells transfection with an empty vector was added in a 1:10 volume ratio to the standard curve samples. The samples were tested using a prothrombin time assay as follows. The samples were incubated at 37 C in a molecular devices plate reader spectrophotometer for 3 minutes at which point the clotting reaction was initiated by the addition of 2 volumes of thromboplastin (Dade Innovin, B4212-50) per one volume of sample. The turbidity was monitored at 405 nm for 5 minutes to create reaction profiles. The PT time, or time to onset of clotting activity, was defined as the first time where OD405 nm increased by 0.06 over baseline. A log-linear standard curve was created with the log of activity relating linearly to the PT time. From this the activity of the sample in the plate well was determined and then the activity in the sample determined by multiplying by 11 to account for the dilution into the FVII deficient plasma. Based upon duplicate measurements the activity of the FVII-XTEN fusion was 203 mUnits/ml. The reaction profiles are presented in FIG. 9, where the FVII deficient plasma is shown as a bold-dashed line, three samples from the standard are shown as dashed lines and the FVII-XTEN sample is shown as a bold line.

Example 68

Factor VII-XTEN Fusion Protein Purification

Figure 46:
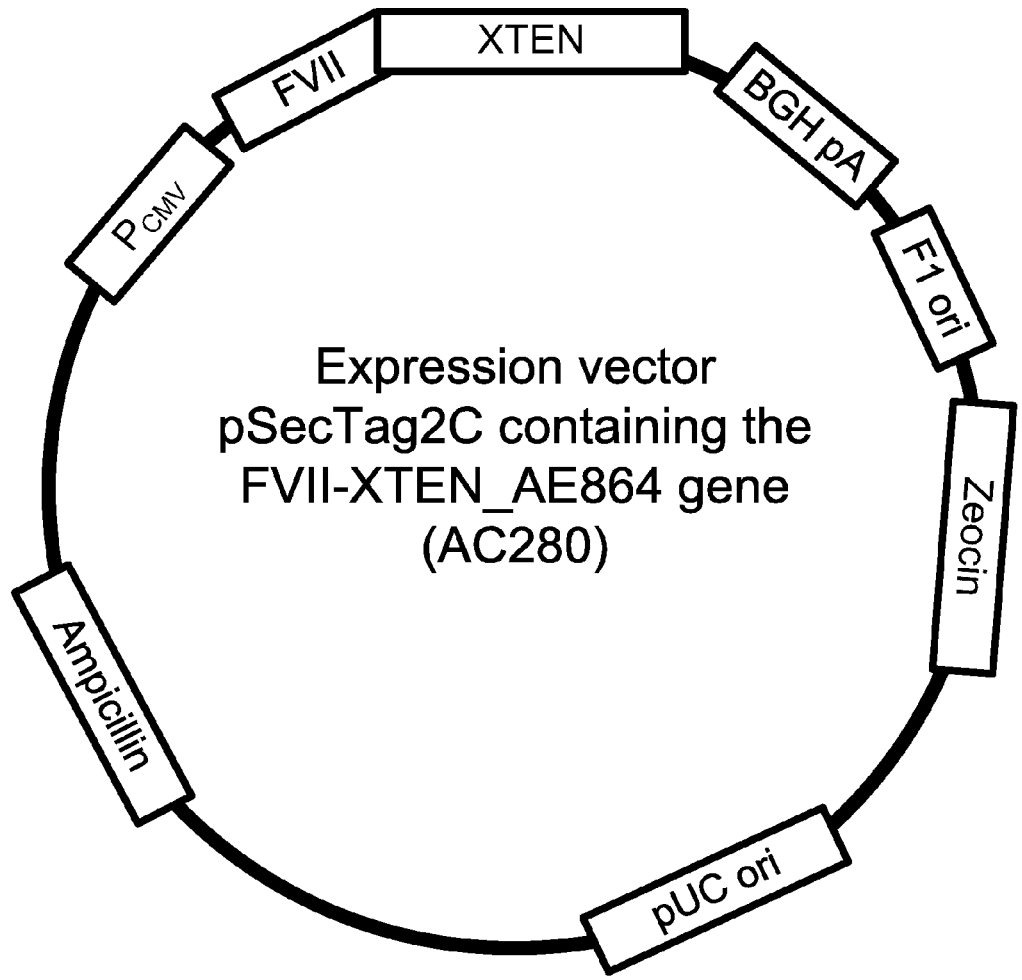
FIG. 46 is a plasmid map of the expression vector pCW0590 containing the FVII-XTEN gene.
Figure 47:
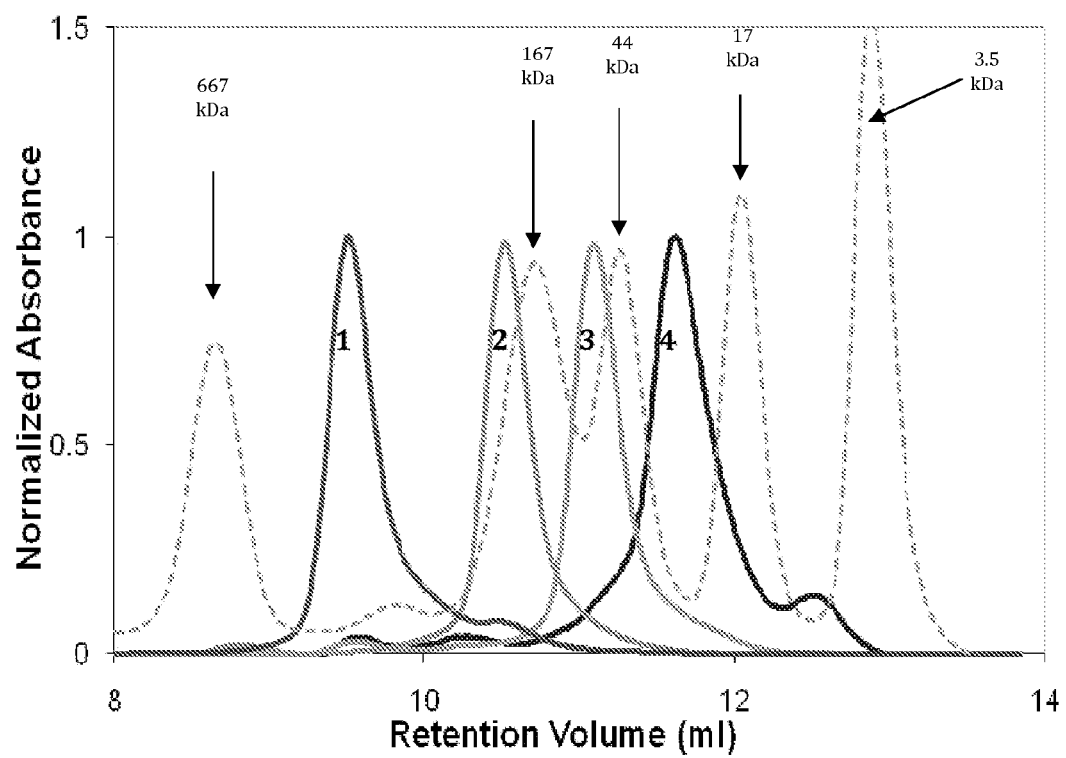
FIG. 47 shows results of a of a size exclusion chromatography analysis of glucagon-XTEN construct samples measured against protein standards of known molecular weight, with the graph output as absorbance versus retention volume. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety.

FVII-XTEN fusion protein can be expressed in a variety of mammalian expression vectors. Vector pCW05090 that is based on pSecTag2 (Invitrogen) is illustrated in FIG. 46. The expression construct contains an expression cassette comprising the CMV promoter, the signal peptide of FVII, the propeptide of FVII, the mature FVII gene fused to the gene encoding XTEN_AE864, followed by a polyadenylation site. The vector contains a zeosin marker for selection in mammalian cells, a pUC origin of replication for E. coli, and an ampicillin marker for selection in E. coli. The expression vector can be transfected into CHO cells, HEK293, PER.C6 cells, or BHK cells for expression. Expression can be monitored by ELISA or clotting assay. FVII-XTEN fusion proteins can be purified by ion exchange in particular anion exchange. Initial Process Capture by Anion Exchange Chromatography.

Cell culture medium was directly applied to 800 ml of Macrocap Q anion exchange resin (GE Life Sciences) that had been equilibrated with 20 mM Tris pH 6.8, 50 mM NaCl. The column was sequentially washed with Tris pH 6.8 buffer containing 50 mM, 100 mM, and 150 mM NaCl. The product was eluted with 20 mM Tris pH 6.8, 250 mM NaCl and verified using the methods of Example 67.

Example 69 aPTT Assays for FIX Activity Determination

Factor IX is in the intrinsic or contact activated coagulation pathway. The activity of this coagulation pathway is used to assess the activity of FIX-XTEN and proteolytic by-products using an activated partial thromboplastin time assay (aPTT). FIX activity specifically was measured as follows, a standard curve was prepared by diluting normal control plasma (Pacific Hemostasis cat#100595) two fold with FIX deficient plasma (cat#100900) and then conducting 6, 4 fold serial dilutions again with factor IX deficient plasma. This created a standard curve with points at 500, 130, 31, 7.8, 2.0, 0.5 and 0.1 mUnits/ml of activity, where one unit of activity is defined as the amount of FIX activity in 1 ml of normal human plasma. A FIX-deficient plasma was also included to determine the background level of activity in the null plasma. The sample was prepared by adding FIX-XTEN secreted by CHO cells that were transiently transfected with a vector containing FIX-XTEN coding sequence in conditioned media from the cell growth, to FIX deficient plasma at a ratio of 1:10 by volume. To compensate for possible interference from the conditioned media, conditioned media from a CHO cells transfection with an empty vector was added in a 1:10 volume ratio to the standard curve samples. The samples were tested using an aPTT assay as follows. The samples were incubated at 37 C in a molecular devices plate reader spectrophotometer for 2 minutes at which point an equal volume of aPTT reagent (Pacific Hemostasis cat#100402) was added and an additional 3 minute 37 C incubation performed. After the incubation the assay was activated by adding one volume of calcium chloride (Pacific Hemostasis cat#100304). The turbidity was monitored at 450 nm for 5 minutes to create reaction profiles. The aPTT time, or time to onset of clotting activity, was defined as the first time where OD450 nm increased by 0.06 over baseline. A log-linear standard curve was created with the log of activity relating linearly to the aPTT time. From this the activity of the sample in the plate well was determined and then the activity in the sample determined by multiplying by 11 to account for the dilution into the FIX deficient plasma.

Example 70

ELISA Assays for FIX Concentration Determination

Factor IX concentrations for the various FIX-XTEN compositions and proteolytic by-products were determined using an ELISA assay with a specific matching pair of antibodies, where the detection antibody was conjugated to HRP to simplify detection (Affinity Biologicals cat# FIX-EIA). The capture antibody was coated at 4° C. overnight on to a high binding 96 well assay plate (Corning 3690). The plate was blocked with 3% BSA in PBS for 1 hour at room temperature. The plate was washed 6 times in PBST with a plate washer. Samples or standards, diluted in PBST, were then bound into the appropriate wells for 2 hours at room temperature. The standard curve ranged from 25 ng/ml to <1 pg/ml and was prepared by serially diluting commercial FIX at a know concentration (Abcam Cat# ab62544) in PBST. The plate was again washed 6 times with PBST using a plate washer. The FIX was then detected using the detection antibody which was bound for 1 hour at 37° C. The plate was again washed 6 times with PBST using a plate washer and washed one further time with water. Signal was then developed with TMB substrate and quantified by reading at 405 nm on a molecular devices plate reader spectrophotometer. A four parameter fit is then performed on the standards and the concentration of the samples determined by comparison to the standard curve.

Example 71

Human Clinical Trial Designs for Evaluating BPXTEN

Clinical trials can be designed such that the efficacy and advantages of the BPXTEN compositions, relative to single biologics, can be verified in humans. For example, the BPXTEN fusion constructs comprising both glucagon and exenatide, as described in the Examples above, can be used in clinical trials for characterizing the efficacy of the compositions. The trials could be conducted in one or more metabolic diseases, disorders, or conditions that is improved, ameliorated, or inhibited by the administration of glucagon and exenatide. Such studies in adult patients would comprise three phases. First, a Phase I safety and pharmacokinetics study in adult patients would be conducted to determine the maximum tolerated dose and pharmacokinetics and pharmacodynamics in humans (either normal subjects or patients with a metabolic disease or condition), as well as to define potential toxicities and adverse events to be tracked in future studies. The study would be conducted in which single rising doses of compositions of fusion proteins of XTEN linked to glucagon and exenatide would be administered and biochemical, PK, and clinical parameters would be measured. This would permit the determination of the maximum tolerated dose and establish the threshold and maximum concentrations in dosage and circulating drug that constitute the therapeutic window for the respective components. Thereafter, clinical trials would be conducted in patients with the disease, disorder or condition.

Clinical Trial in Diabetes

A phase II dosing study would be conducted in diabetic patients where serum glucose pharmacodynamics and other physiologic, PK, safety and clinical parameters (such as listed below) appropriate for diabetes, insulin resistance and obesity conditions would be measured as a function of the dosing of the fusion proteins comprising XTEN linked to glucagon and exenatide, yielding dose-ranging information on doses appropriate for a Phase III trial, in addition to collecting safety data related to adverse events. The PK parameters would be correlated to the physiologic, clinical and safety parameter data to establish the therapeutic window for each component of the BPXTEN composition, permitting the clinician to establish either the appropriate ratio of the two component fusion proteins each comprising one glucose regulating peptide, or to determine the single dose for a monomeric BPXTEN comprising two glucose regulating peptides. Finally, a phase III efficacy study would be conducted wherein diabetic patients would be administered either the BPXTEN composition, a positive control, or a placebo daily, bi-weekly, or weekly (or other dosing schedule deemed appropriate given the pharmacokinetic and pharmacodynamic properties of the BPXTEN composition) for an extended period of time. Primary outcome measures of efficacy could include HbA1c concentrations, while secondary outcome measures could include insulin requirement during the study, stimulated C peptide and insulin concentrations, fasting plasma glucose (FPG), serum cytokine levels, CRP levels, and insulin secretion and Insulin-sensitivity index derived from an OGTT with insulin and glucose measurements, as well as body weight, food consumption, and other accepted diabetic markers that would be tracked relative to the placebo or positive control group. Efficacy outcomes would be determined using standard statistical methods. Toxicity and adverse event markers would also be followed in this study to verify that the compound is safe when used in the manner described.

Clinical Trial in Arthritis

A phase II clinical study of human patients would be conducted in arthritis patients administered BPXTEN comprising XTEN linked to IL-1ra and/or anti-IL-2, anti-CD3 or a suitable anti-inflammatory protein to determine an appropriate dose to relieve at least one symptom associated with rheumatoid arthritis, including reducing joint swelling, joint tenderness, inflammation, morning stiffness, and pain, or at least one biological surrogate marker associated with rheumatoid arthritis, including reducing erythrocyte sedimentation rates, and serum levels of C-reactive protein and/or IL2 receptor. In addition, safety data related to adverse events would be collected. A phase III efficacy study would be conducted wherein arthritis patients would be administered either the BPXTEN, a positive control, or a placebo daily, bi-weekly, or weekly (or other dosing schedule deemed appropriate given the pharmacokinetic and pharmacodynamic properties of the compound) for an extended period of time. Patients would be evaluated for baseline symptoms of disease activity prior to receiving any treatments, including joint swelling, joint tenderness, inflammation, morning stiffness, disease activity evaluated by patient and physician as well as disability evaluated by, for example, a standardized Health Questionnaire Assessment (HAQ), and pain. Additional baseline evaluations could include erythrocyte sedimentation rates (ESR), serum levels of C-reactive protein (CRP) and soluble IL-2 receptor (IL-2r). The clinical response to treatment could be assessed using the criteria established by the American College of Rheumatology (ACR), such as the ACR20 criterion; i.e., if there was a 20 percent improvement in tender and swollen joint counts and 20 percent improvement in three of the five remaining symptoms measured, such as patient and physician global disease changes, pain, disability, and an acute phase reactant (Felson, D. T., et al., 1993 Arthritis and Rheumatism 36:729-740; Felson, D. T., et al., 1995 Arthritis and Rheumatism 38:1-9). Similarly, a subject would satisfy the ACR50 or ACR70 criterion if there was a 50 or 70 percent improvement, respectively, in tender and swollen joint counts and 50 or 70 percent improvement, respectively, in three of the five remaining symptoms measured, such as patient and physician global disease changes, pain, physical disability, and an acute phase reactant such as CRP or ESR. In addition, potential biomarkers of disease activity could be measured, including rheumatoid factor, CRP, ESR, soluble IL-2R, soluble ICAM-1, soluble E-selectin, and MMP-3. Efficacy outcomes would be determined using standard statistical methods. Toxicity and adverse event markers would also be followed in this study to verify that the compound is safe when used in the manner described.

Clinical Trial in Acute Coronary Syndrome and Acute Myocardial Infarction.

A phase III trial in acute coronary syndrome (ACS) and/or acute myocardial infarction (AMI) would be conducted wherein patients diagnosed with ACS and/or AMI would be administered either a BPXTEN fusion protein comprising, for example, IL-1ra and BNP, a positive control, the combination of the BPXTEN fusion protein plus a positive control substance, or a placebo daily, bi-weekly, or weekly (or other dosing schedule deemed appropriate given the pharmacokinetic and pharmacodynamic properties of the compound) for an extended period of time. The study would be conducted to determine whether the BPXTEN is superior to the other treatment regimens for preventing cardiovascular death, non-fatal myocardial infarction, or ischemic stroke in subjects with a recent acute coronary syndrome. Patients would be evaluated for baseline symptoms of disease activity prior to receiving any treatments, including signs or symptoms of unstable angina, chest pain experienced as tightness around the chest radiating to the left arm and the left angle of the jaw, diaphoresis (sweating), nausea and vomiting, shortness of breath, as well as electrocardiogram (ECG) evidence of non-Q-wave myocardial infarction and Q-wave myocardial infarction. Additional baseline evaluations could include measurement of biomarkers, including ischemia-modified albumin (IMA), myeloperoxidase (MPO), glycogen phosphorylase isoenzyme BB-(GPBB), troponin, natriuretic peptide (both B-type natriuretic peptide (BNP) and N-terminal Pro BNP), and monocyte chemo attractive protein (MCP)-1. The clinical response to treatment could be assessed using time to first occurrence of cardiovascular death, myocardial infarction, or ischemic stroke as primary outcome measures, while occurrences of or time to first unstable angina, hemorrhagic stroke, or fatal bleeding could serve as secondary outcome measures. Efficacy outcomes would be determined using standard statistical methods. Toxicity and adverse event markers would also be followed in this study to verify that the compound is safe when used in the manner described.

Example 72

Analysis of Sequences for Secondary Structure by Prediction Algorithms

Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=miscl as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 32.

The results indicate that, by the Chou-Fasman calculations, the four motifs of the AE family (Table 1) have no alpha-helices or beta sheets. The sequence up to 288 residues was similarly found to have no alpha-helices or beta sheets. The 432 residue sequence is predicted to have a small amount of secondary structure, with only 2 amino acids contributing to an alpha-helix for an overall percentage of 0.5%. The full-length AF864 polypeptide has the same two amino acids contributing to an alpha-helix, for an overall percentage of 0.2%. Calculations for random coil formation revealed that with increasing length, the percentage of random coil formation increased. The first 24 amino acids of the sequence had 91% random coil formation, which increased with increasing length up to the 99.77% value for the full-length sequence.

Numerous XTEN sequences of 500 amino acids or longer from the other motif families were also analyzed and revealed that the majority had greater than 95% random coil formation. The exceptions were those sequences with one or more instances of three contiguous serine residues, which resulted in predicted beta-sheet formation. However, even these sequences still had approximately 99% random coil formation.

In contrast, a polypeptide sequence of 84 residues limited to A, S, and P amino acids was assessed by the Chou-Fasman algorithm, which predicted a high degree of predicted alpha-helices. The sequence, which had multiple repeat "AA" and "AAA" sequences, had an overall predicted percentage of alpha-helix structure of 69%. The GOR algorithm predicted 78.57% random coil formation; far less than any sequence consisting of 12 amino acid sequence motifs consisting of the amino acids G, S, T, E, P, analyzed in the present Example.

Conclusions:

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. In contrast, polypeptides created from amino acids limited to A, S and P that have a higher degree of internal repetitiveness are predicted to have a high percentage of alpha-helices, as determined by the Chou-Fasman algorithm, as well as random coil formation. Based on the numerous sequences evaluated by these methods, it is generally the case that XTEN created from sequence motifs of G, S, T, E, P, and A that have limited repetitiveness (defined as no more than two identical contiguous amino acids in any one motif) greater than about 400 amino acid residues in length are expected to have very limited secondary structure. With the exception of motifs containing three contiguous serines, it is believed that any order or combination of sequence motifs from Table 1 can be used to create an XTEN polypeptide of a length greater than about 400 residues that will result in an XTEN sequence that is substantially devoid of secondary structure. Such sequences are expected to have the characteristics described in the BPXTEN embodiments of the invention disclosed herein.

TABLE 32

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | 758 | GSTSESPSGTAP | 12 | Residue totals*: H: 0 E: 0<br>percent: H: 0.0 E: 0.0 | Not Determined |
| | 759 | GTS TPESGSASP | 12 | Residue totals: H: 0 E: 0<br>percent: H: 0.0 E: 0.0 | Not Determined |
| | 760 | GTSPSGESSTAP | 12 | Residue totals: H: 0 E: 0<br>percent: H: 0.0 E: 0.0 | Not Determined |
| | 761 | GSTSSTAESPGP | 12 | Residue totals: H: 0 E: 0<br>percent: H: 0.0 E: 0.0 | Not Determined |
| | 762 | GSPAGSPTSTEEGTSESATPESGP | 24 | Residue totals: H: 0 E: 0<br>percent: H: 0.0 E: 0.0 | 91.67% |
| | 763 | GSPAGSPTSTEEGTSESATPESG<br>PGTSTEPSEGSAP | 36 | Residue totals: H: 0 E: 0<br>percent: H: 0.0 E: 0.0 | 94.44% |
| | 764 | GSPAGSPTSTEEGTSESATPESG<br>PGTSTEPSEGSAPGSPAGSPTST<br>EE | 48 | Residue totals: H: 0 E: 0<br>percent: H: 0.0 E: 0.0 | 93.75% |
| | 765 | GSPAGSPTSTEEGTSESATPESG<br>PGTSTEPSEGSAPGSPAGSPTST<br>EEGTSTEPSEGSAP | 60 | Residue totals: H: 0 E: 0<br>percent: H: 0.0 E: 0.0 | 96.67% |
| | 766 | GSPAGSPTSTEEGTSESATPESG<br>PGTSTEPSEGSAPGSPAGSPTST<br>EEGTSTEPSEGSAPGTSTEPSEG<br>SAPGTSESATPESGPGSEPATSG<br>SE TPGSEPATSGSETP | 108 | Residue totals: H: 0 E: 0<br>percent: H: 0.0 E: 0.0 | 97.22% |
| | 767 | GSPAGSPTSTEEGTSESATPESG<br>PGTSTEPSEGSAPGSPAGSPTST<br>EEGTSTEPSEGSAPGTSTEPSEG<br>SAPGTSESATPESGPGSEPATSG<br>SETPGSEPATSGSETPGSPAGSP<br>TSTEEGTSESATPESGPGTSTEPS | 216 | Residue totals: H: 0 E: 0<br>percent: H: 0.0 E: 0.0 | 99.07% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | EGSAPGTSTEPSEGSAPGSPAGS PTSTEEGTSTEPSEGSAPGTSTEP SEGSAPGTSESATPESGPGTSTE PSEGSAP | | | |
| | 768 | GSPAGSPTSTEEGTSESATPESG PGTSTEPSEGSAPGSPAGSPTST EEGTSTEPSEGSAPGTSTEPSEG SAPGTSESATPESGPGSEPATSG SETPGSEPATSGSETPGSPAGSP TSTEEGTSESATPESGPGTSTEPS EGSAPGTSTEPSEGSAPGSPAGS PTSTEEGTSTEPSEGSAPGTSTEP SEGSAPGTSESATPESGPGTSTE PSEGSAPGTSESATPESGPGSEP ATSGSETPGTSTEPSEGSAPGTS TEPSEGSAPGTSESATPESGPGT SESATPESGPGSPAGSPTSTEEG TSESATPESGPGSEPATSGSETP GTSESATPESGPGTSTEPSEGSA PGTSTEPSEGSAPGTSTEPSEGS APGTSTEPSEGSAPGTSTEPSEG SAPGTSTEPSEGSAPGSPAGSPT STEEGTSTEPSEGSAP | 432 | Residue totals: H: 2 E: 3 percent: H: 0.5 E: 0.7 | 99.54% |
| AE864 | 769 | GSPAGSPTSTEEGTSESATPESG PGTSTEPSEGSAPGSPAGSPTST EEGTSTEPSEGSAPGTSTEPSEG SAPGTSESATPESGPGSEPATSG SETPGSEPATSGSETPGSPAGSP TSTEEGTSESATPESGPGTSTEPS EGSAPGTSTEPSEGSAPGSPAGS PTSTEEGTSTEPSEGSAPGTSTEP SEGSAPGTSESATPESGPGTSTE PSEGSAPGTSESATPESGPGSEP ATSGSETPGTSTEPSEGSAPGTS TEPSEGSAPGTSESATPESGPGT SESATPESGPGSPAGSPTSTEEG TSESATPESGPGSEPATSGSETP GTSESATPESGPGTSTEPSEGSA PGTSTEPSEGSAPGTSTEPSEGS APGTSTEPSEGSAPGTSTEPSEG SAPGTSTEPSEGSAPGSPAGSPT STEEGTSTEPSEGSAPGTSESAT PESGPGSEPATSGSETPGTSESA TPESGPGSEPATSGSETPGTSES ATPESGPGTSTEPSEGSAPGTSE SATPESGPGSPAGSPTSTEEGSP AGSPTSTEEGSPAGSPTSTEEGT SESATPESGPGTSTEPSEGSAPG TSESATPESGPGSEPATSGSETP GTSESATPESGPGSEPATSGSET PGTSESATPESGPGTSTEPSEGS APGSPAGSPTSTEEGTSESATPE SGPGSEPATSGSETPGTSESATP ESGPGSPAGSPTSTEEGSPAGSP TSTEEGTSTEPSEGSAPGTSESA TPESGPGTSESATPESGPGTSES ATPESGPGSEPATSGSETPGSEP ATSGSETPGSPAGSPTSTEEGTS TEPSEGSAPGTSTEPSEGSAPGS EPATSGSETPGTSESATPESGPG TSTEPSEGSAP | 864 | Residue totals: H: 2 E: 3 percent: H: 0.2 E: 0.3 | 99.77% |
| AD576 | 770 | GSSESGSSEGGPGSGGEPSESGS SGSSESGSSEGGPGSSESGSSEG GPGSSESGSSEGGPGSSESGSSE GGPGSSESGSSEGGPGESPGGSS GSESGSEGSSGPGESSGSSESGS SEGGPGSSESGSSEGGPGSSESG SSEGGPGSGGEPSESGSSGESPG GSSGSESGESPGGSSGSESGSGG EPSESGSSGSSESGSSEGGPGSG GEPSESGSSGGGEPSESGSSGS EGSSGPGESSGESPGGSSGSESG | 576 | Residue totals: H: 7 E: 0 percent: H: 1.2 E: 0.0 | 99.65% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | SGGEPSESGSSGSGGEPSESGSS GSGGEPSESGSSGSSESGSSEGG PGESPGGSSGSESGESPGGSSGS ESGESPGGSSGSESGESPGGSSG SESGESPGGSSGSESGSSESGSSE GGPGSGGEPSESGSSGSEGSSGP GESSGSSESGSSEGGPGSGGEPS ESGSSGSSESGSSEGGPGSGGEP SESGSSGESPGGSSGSESGESPG GSSGSESGSSESGSSEGGPGSGG EPSESGSSGSSESGSSEGGPGSG GEPSESGSSGSGGEPSESGSSGE SPGGSSGSESGSEGSSGPGESSG SSESGSSEGGPGSEGSSGPGESS | | | |
| AE576 | 771 | GSPAGSPTSTEEGTSESATPESG PGTSTEPSEGSAPGSPAGSPTST EEGTSTEPSEGSAPGTSTEPSEG SAPGTSESATPESGPGSEPATSG SETPGSEPATSGSETPGSPAGSP TSTEEGTSESATPESGPGTSTEPS EGSAPGTSTEPSEGSAPGSPAGS PTSTEEGTSTEPSEGSAPGTSTEP SEGSAPGTSESATPESGPGTSTE PSEGSAPGTSESATPESGPGSEP ATSGSETPGTSTEPSEGSAPGTS TEPSEGSAPGTSESATPESGPGT SESATPESGPGSPAGSPTSTEEG TSESATPESGPGSEPATSGSETP GTSESATPESGPGTSTEPSEGSA PGTSTEPSEGSAPGTSTEPSEGS APGTSTEPSEGSAPGTSTEPSEG SAPGTSTEPSEGSAPGSPAGSPT STEEGTSTEPSEGSAPGTSESAT PESGPGSEPATSGSETPGTSESA TPESGPGSEPATSGSETPGTSES ATPESGPGTSTEPSEGSAPGTSE SATPESGPGSPAGSPTSTEEGSP AGSPTSTEEGSPAGSPTSTE7EG TSESATPESGPGTSTEPSEGSAP | 576 | Residue totals: H: 2 E: 0 percent: H: 0.4 E: 0.0 | 99.65% |
| AF540 | 772 | GSTSSTAESPGPGSTSSTAESPG PGSTSESPSGTAPGSTSSTAESP GPGSTSSTAESPGPGTSTPESGS ASPGSTSESPSGTAPGTSPSGESS TAPGSTSESPSGTAPGSTSESPS GTAPGTSPSGESSTAPGSTSESP SGTAPGSTSESPSGTAPGTSPSG ESSTAPGSTSESPSGTAPGSTSES PSGTAPGSTSESPSGTAPGTSTP ESGSASPGSTSESPSGTAPGTST PESGSASPGSTSSTAESPGPGSTS STAESPGPGTSTPESGSASPGTS TPESGSASPGSTSESPSGTAPGT STPESGSASPGTSTPESGSASPGS TSESPSGTAPGSTSESPSGTAPG STSESPSGTAPGSTSSTAESPGP GTSTPESGSASPGTSTPESGSAS PGSTSESPSGTAPGSTSESPSGT APGTSTPESGSASPGSTSESPSG TAPGSTSESPSGTAPGTSTPESG SASPGTSPSGESSTAPGSTSSTA ESPGPGTSPSGESSTAPGSTSST AESPGPGTSTPESGSASPGSTSE SPSGTAP | 540 | Residue totals: H: 2 E: 0 percent: H: 0.4 E: 0.0 | 99.65 |
| AF504 | 773 | GASPGTSSTGSPGSSPSASTGTG PGSSPSASTGTGPGTPGSGTASS SPGSSTPSGATGSPGSNPSASTG TGPGASPGTSSTGSPGTPGSGTA SSSPGSSTPSGATGSPGTPGSGT ASSSPGASPGTSSTGSPGASPGT SSTGSPGTPGSGTASSSPGSSTPS GATGSPGASPGTSSTGSPGTPGS GTASSSPGSSTPSGATGSPGSNP | 504 | Residue totals: H: 0 E: 0 percent: H: 0.0 E: 0.0 | 94.44% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | SASTGTGPGSSPSASTGTGPGSS TPSGATGSPGSSTPSGATGSPGA SPGTSSTGSPGASPGTSSTGSPG ASPGTSSTGSPGTPGSGTASSSP GASPGTSSTGSPGASPGTSSTGS PGASPGTSSTGSPGSSPSASTGT GPGTPGSGTASSSPGASPGTSST GSPGASPGTSSTGSPGASPGTSS TGSPGSSTPSGATGSPGSSTPSG ATGSPGASPGTSSTGSPGTPGSG TASSSPGSSTPSGATGSPGSSTPS GATGSPGSSTPSGATGSPGSSPS ASTGTGPGASPGTSSTGSP | | | |
| AE864 | 774 | GSPAGSPTSTEEGTSESATPESG PGTSTEPSEGSAPGSPAGSPTST EEGTSTEPSEGSAPGTSTEPSEG SAPGTSESATPESGPGSEPATSG SETPGSEPATSGSETPGSPAGSP TSTEEGTSESATPESGPGTSTEPS EGSAPGTSTEPSEGSAPGSPAGS PTSTEEGTSTEPSEGSAPGTSTEP SEGSAPGTSESATPESGPGTSTE PSEGSAPGTSESATPESGPGSEP ATSGSETPGTSTEPSEGSAPGTS TEPSEGSAPGTSESATPESGPGT SESATPESGPGSPAGSPTSTEEG TSESATPESGPGSEPATSGSETP GTSESATPESGPGTSTEPSEGSA PGTSTEPSEGSAPGTSTEPSEGS APGTSTEPSEGSAPGTSTEPSEG SAPGTSTEPSEGSAPGSPAGSPT STEEGTSTEPSEGSAPGTSESAT PESGPGSEPATSGSETPGTSESA TPESGPGSEPATSGSETPGTSES ATPESGPGTSTEPSEGSAPGTSE SATPESGPGSPAGSPTSTEEGSP AGSPTSTEEGSPAGSPTSTEEGT SESATPESGPGTSTEPSEGSAPG TSESATPESGPGSEPATSGSETP GTSESATPESGPGSEPATSGSET PGTSESATPESGPGTSTEPSEGS APGSPAGSPTSTEEGTSESATPE SGPGSEPATSGSETPGTSESATP ESGPGSPAGSPTSTEEGSPAGSP TSTEEGTSTEPSEGSAPGTSESA TPESGPGTSESATPESGPGTSES ATPESGPGSEPATSGSETPGSEP ATSGSETPGSPAGSPTSTEEGTS TEPSEGSAPGTSTEPSEGSAPGS EPATSGSETPGTSESATPESGPG TSTEPSEGSAP | 864 | Residue totals: H: 2 E: 3 percent: H: 0.2 E: 0.4 | 99.77% |
| AF864 | 775 | GSTSESPSGTAPGTSPSGESSTA PGSTSESPSGTAPGSTSESPSGT APGTSTPESGSASPGTSTPESGS ASPGSTSESPSGTAPGSTSESPSG TAPGTSPSGESSTAPGSTSESPS GTAPGTSPSGESSTAPGTSPSGE SSTAPGSTSSTAESPGPGTSPSG ESSTAPGTSPSGESSTAPGSTSST AESPGPGTSTPESGSASPGTSTP ESGSASPGSTSESPSGTAPGSTS ESPSGTAPGTSTPESGSASPGST SSTAESPGPGTSTPESGSASPGS TSESPSGTAPGTSPSGESSTAPG STSSTAESPGPGTSPSGESSTAP GTSTPESGSASPGSTSSTAESPG PGSTSSTAESPGPGSTSSTAESP GPGSTSSTAESPGPGTSPSGESS TAPGSTSESPSGTAPGSTSESPS GTAPGTSTPESGPXXXGASASG APSTXXXXSESPSGTAPGSTSES PSGTAPGSTSESPSGTAPGSTSE SPSGTAPGSTSESPSGTAPGSTS | 875 | Residue totals: H: 2 E: 0 percent: H: 0.2 E: 0.0 | 95.20% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | ESPSGTAPGTSTPESGSASPGTS PSGESSTAPGTSPSGESSTAPGS TSSTAESPGPGTSPSGESSTAPG TSTPESGSASPGSTSESPSGTAP GSTSESPSGTAPGTSPSGESSTA PGSTSESPSGTAPGTSTPESGSA SPGTSTPESGSASPGTSESPSGT APGTSTPESGSASPGTSSTAES PGPGSTSESPSGTAPGSTSESPSG TAPGTSPSGESSTAPGSTSSTAE SPGPGTSPSGESSTAPGTSTPES GSASPGTSPSGESSTAPGTSPSG ESSTAPGTSPSGESSTAPGSTSST AESPGPGSTSSTAESPGPGTSPS GESSTAPGSSPSASTGTGPGSST PSGATGSPGSSTPSGATGSP | | | |
| AG864 | 776 | GGSPGASPGTSSTGSPGSSPSAS TGTGPGSSPSASTGTGPGTPGSG TASSSPGSSTPSGATGSPGSNPS ASTGTGPGASPGTSSTGSPGTPG SGTASSSPGSSTPSGATGSPGTP GSGTASSSPGASPGTSSTGSPGA SPGTSSTGSPGTPGSGTASSSPG SSTPSGATGSPGASPGTSSTGSP GTPGSGTASSSPGSSTPSGATGS PGSNPSASTGTGPGSSPSASTGT 7GPGSSTPSGATGSPGSSTPSGA TGSPGASPGTSSTGSPGASPGTS STGSPGASPGTSSTGSPGTPGSG TASSSPGASPGTSSTGSPGASPG TSSTGSPGASPGTSSTGSPGSSPS ASTGTGPGTPGSGTASSSPGASP GTSSTGSPGASPGTSSTGSPGAS PGTSSTGSPGSSTPSGATGSPGS STPSGATGSPGASPGTSSTGSPG TPGSGTASSSPGSSTPSGATGSP GSSTPSGATGSPGSSTPSGATGS PGSSPSASTGTGPGASPGTSSTG SPGASPGTSSTGSPGTPGSGTAS SSPGASPGTSSTGSPGASPGTSS TGSPGASPGTSSTGSPGASPGTS STGSPGTPGSGTASSSPGSSTPS GATGSPGTPGSGTASSSPGSSTP SGATGSPGTPGSGTASSSPGSST PSGATGSPGSSTPSGATGSPGSS PSASTGTGPGSSPSASTGTGPGA SPGTSSTGSPGTPGSGTASSSPG SSTPSGATGSPGSSPSASTGTGP GSSPSASTGTGPGASPGTSSTGS PGASPGTSSTGSPGSSTPSGATG SPGSSPSASTGTGPGASPGTSST GSPGSSPSASTGTGPGTPGSGTA SSSPGSSTPSGATGSPGSSTPSG ATGSPGASPGTSSTGSP | 868 | Residue totals: H: 0 E: 0 percent: H: 0.0 E: 0.0 | 94.70% |
| AM875 | 777 | GTSTEPSEGSAPGSEPATSGSET PGSPAGSPTSTEEGSTSSTAESP GPGTSTPESGSASPGSTSESPSG TAPGSTSESPSGTAPGTSTPESG SASPGTSTPESGSASPGSEPATS GSETPGTSESATPESGPGSPAGS PTSTEEGTSTEPSEGSAPGTSES ATPESGPGTSTEPSEGSAPGTST EPSEGSAPGSPAGSPTSTEEGTS TEPSEGSAPGTSTEPSEGSAPGT SESATPESGPGTSESATPESGPG TSTEPSEGSAPGTSTEPSEGSAP GTSESATPESGPGTSTEPSEGSA PGSEPATSGSETPGSPAGSPTST EEGSSTPSGATGSPGTPGSGTAS SSPGSSTPSGATGSPGTSTEPSE GSAPGTSTEPSEGSAPGSEPATS GSETPGSPAGSPTSTEEGSPAGS PTSTEEGTSTEPSEGSAPGASAS | 875 | Residue totals: H: 7 E: 3 percent: H: 0.8 E: 0.3 | 98.63% |

… 233 234

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | GAPSTGGTSESATPESGPGSPAG SPTSTEEGSPAGSPTSTEEGSTSS TAESPGPGSTSESPSGTAPGTSP SGESSTAPGTPGSGTASSSPGSS TPSGATGSPGSSPSASTGTGPGS EPATSGSETPGTSESATPESGPG SEPATSGSETPGSTSSTAESPGP GSTSSTAESPGPGTSPSGESSTA PGSEPATSGSETPGSEPATSGSE TPGTSTEPSEGSAPGSTSSTAESP GPGTSTPESGSASPGSTSESPSG TAPGTSTEPSEGSAPGTSTEPSE GSAPGTSTEPSEGSAPGSSTPSG ATGSPGSSPSASTGTGPGASPGT SSTGSPGSEPATSGSETPGTSES ATPESGPGSPAGSPTSTEEGSST PSGATGSPGSSPSASTGTGPGAS PGTSSTGSPGTSESATPESGPGT STEPSEGSAPGTSTEPSEGSAP | | | |
| AM1296 | 778 | GTSTEPSEGSAPGSEPATSGSET PGSPAGSPTSTEEGSTSSTAESP GPGTSTPESGSASPGSTSESPSG TAPGSTSESPSGTAPGTSTPESG SASPGTSTPESGSASPGSEPATS GSETPGTSESATPESGPGSPAGS PTSTEEGTSTEPSEGSAPGTSES ATPESGPGTSTEPSEGSAPGTST EPSEGSAPGSPAGSPTSTEEGTS TEPSEGSAPGTSTEPSEGSAPGT SESATPESGPGTSESATPESGPG TSTEPSEGSAPGTSTEPSEGSAP GTSESATPESGPGTSTEPSEGSA PGSEPATSGSETPGSPAGSPTST EEGSSTPSGATGSPGTPGSGTAS SSPGSSTPSGATGSPGTSTEPSE GSAPGTSTEPSEGSAPGSEPATS GSETPGSPAGSPTSTEEGSPAGS PTSTEEGTSTEPSEGSAPGPEPT GPAPSGGSEPATSGSETPGTSES ATPESGPGSPAGSPTSTEEGTSE SATPESGPGSPAGSPTSTEEGSP AGSPTSTEEGTSESATPESGPGS PAGSPTSTEEGSPAGSPTSTEEG STSSTAESPGPGSTSESPSGTAP GTSPSGESSTAPGSTSESPSGTA PGSTSESPSGTAPGTSPSGESST APGTSTEPSEGSAPGTSESATPE SGPGTSESATPESGPGSEPATSG SETPGTSESATPESGPGTSESATP ESGPGTSTEPSEGSAPGTSESAT PESGPGTSTEPSEGSAPGTSPSG ESSTAPGTSPSGESSTAPGTSPS GESSTAPGTSTEPSEGSAPGSPA GSPTSTEEGTSTEPSEGSAPGSSP SASTGTGPGSSTPSGATGSPGSS TPSGATGSPGSSTPSGATGSPGS STPSGATGSPGASPGTSSTGSPG ASASGAPSTGGTSPSGESSTAPG STSSTAESPGPGTSPSGESSTAP GTSESATPESGPGTSTEPSEGSA PGTSTEPSEGSAPGSSPSASTGT GPGSSTPSGATGSPGASPGTSST GSPGTSTPESGSASPGTSPSGESS TAPGTSPSGESSTAPGTSESATP ESGPGSEPATSGSETPGTSTEPSE GSAPGSTSESPSGTAPGSTSESPS GTAPGTSTPESGSASPGSPAGSP TSTEEGTSESATPESGPGTSTEPS EGSAPGSPAGSPTSTEEGTSESA TPESGPGSEPATSGSETPGSSTPS GATGSPGASPGTSSTGSPGSSTP SGATGSPGSTSESPSGTAPGTSP SGESSTAPGSTSSTAESPGPGSS TPSGATGSPGASPGTSSTGSPGT | 1318 | Residue totals: H: 7 E: 0 percent: H: 0.7 E: 0.0 | 99.17% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | PGSGTASSSPGSPAGSPTSTEEG SPAGSPTSTEEGTSTEPSEGSAP | | | |
| AM923 | 779 | MAEPAGSPTSTEEGASPGTSSTG SPGSSTPSGATGSPGSSTPSGAT GSPGTSTEPSEGSAPGSEPATSG SETPGSPAGSPTSTEEGSTSSTAE SPGPGTSTPESGSASPGSTSESPS GTAPGSTSESPSGTAPGTSTPES GSASPGTSTPESGSASPGSEPAT SGSETPGTSESATPESGPGSPAG SPTSTEEGTSTEPSEGSAPGTSES ATPESGPGTSTEPSEGSAPGTST EPSEGSAPGSPAGSPTSTEEGTS TEPSEGSAPGTSTEPSEGSAPGT SESATPESGPGTSESATPESGPG TSTEPSEGSAPGTSTEPSEGSAP GTSESATPESGPGTSTEPSEGSA PGSEPATSGSETPGSPAGSPTST EEGSSTPSGATGSPGTPGSGTAS SSPGSSTPSGATGSPGTSTEPSE GSAPGTSTEPSEGSAPGSEPATS GSETPGSPAGSPTSTEEGSPAGS PTSTEEGTSTEPSEGSAPGASAS GAPSTGGTSESATPESGPGSPAG SPTSTEEGSPAGSPTSTEEGSTSS TAESPGPGSTSESPSGTAPGTSP SGESSTAPGTPGSGTASSSPGSS TPSGATGSPGSSPSASTGTGPGS EPATSGSETPGTSESATPESGPG SEPATSGSETPGTSSTAESPGP GSTSSTAESPGPGTSPSGESSTA PGSEPATSGSETPGSEPATSGSE TPGTSTEPSEGSAPGSTSSTAESP GPGTSTPESGSASPGSTSESPSG TAPGTSTEPSEGSAPGTSTEPSE GSAPGTSTEPSEGSAPGSSTPSG ATGSPGSSPSASTGTGPGASPGT SSTGSPGSEPATSGSETPGTSES ATPESGPGSPAGSPTSTEEGSST PSGATGSPGSSPSASTGTGPGAS PGTSSTGSPGTSESATPESGPGT STEPSEGSAPGTSTEPSEGSAP | 924 | Residue totals: H: 4 E: 3 percent: H: 0.4 E: 0.3 | 98.70% |
| AE912 | 780 | MAEPAGSPTSTEEGTPGSGTASS SPGSSTPSGATGSPGASPGTSST GSPGSPAGSPTSTEEGTSESATP ESGPGTSTEPSEGSAPGSPAGSP TSTEEGTSTEPSEGSAPGTSTEPS EGSAPGTSESATPESGPGSEPAT SGSETPGSEPATSGSETPGSPAG SPTSTEEGTSESATPESGPGTSTE PSEGSAPGTSTEPSEGSAPGSPA GSPTSTEEGTSTEPSEGSAPGTS TEPSEGSAPGTSESATPESGPGT STEPSEGSAPGTSESATPESGPG SEPATSGSETPGTSTEPSEGSAP GTSTEPSEGSAPGTSESATPESG PGTSESATPESGPGSPAGSPTST EEGTSESATPESGPGSEPATSGS ETPGTSESATPESGPGTSTEPSE GSAPGTSTEPSEGSAPGTSTEPS EGSAPGTSTEPSEGSAPGTSTEP SEGSAPGTSTEPSEGSAPGSPAG SPTSTEEGTSTEPSEGSAPGTSES ATPESGPGSEPATSGSETPGTSE SATPESGPGSEPATSGSETPGTS ESATPESGPGTSTEPSEGSAPGT SESATPESGPGSPAGSPTSTEEG SPAGSPTSTEEGSPAGSPTSTEE GTSESATPESGPGTSTEPSEGSA PGTSESATPESGPGSEPATSGSE TPGTSESATPESGPGSEPATSGS ETPGTSESATPESGPGTSTEPSE GSAPGSPAGSPTSTEEGTSESAT | 913 | Residue totals: H: 8 E: 3 percent: H: 0.9 E: 0.3 | 99.45% |

TABLE 32-continued

CHOU-FASMAN and GOR prediction calculations of polypeptide sequences

| SEQ NAME | SEQ ID NO: | Sequence | No. Residues | Chou-Fasman Calculation | GOR Calculation |
|---|---|---|---|---|---|
| | | PESGPGSEPATSGSETPGTSESA<br>TPESGPGSPAGSPTSTEEGSPAG<br>SPTSTEEGTSTEPSEGSAPGTSES<br>ATPESGPGTSESATPESGPGTSE<br>SATPESGPGSEPATSGSETPGSE<br>PATSGSETPGSPAGSPTSTEEGT<br>STEPSEGSAPGTSTEPSEGSAPG<br>SEPATSGSETPGTSESATPESGP<br>GTSTEPSEGSAP | | | |
| BC 864 | 220 | GTSTEPSEPGSAGTSTEPSEPGS<br>AGSEPATSGTEPSGSGASEPTST<br>EPGSEPATSGTEPSGSEPATSGT<br>EPSGSEPATSGTEPSGSGASEPT<br>STEPGTSTEPSEPGSAGSEPATS<br>GTEPSGTSTEPSEPGSAGSEPAT<br>SGTEPSGSEPATSGTEPSGTSTEP<br>SEPGSAGTSTEPSEPGSAGSEPA<br>TSGTEPSGSEPATSGTEPSGTSEP<br>STSEPGAGSGASEPTSTEPGTSE<br>PSTSEPGAGSEPATSGTEPSGSE<br>PATSGTEPSGTSTEPSEPGSAGT<br>STEPSEPGSAGSGASEPTSTEPG<br>SEPATSGTEPSGSEPATSGTEPS<br>GSEPATSGTEPSGSEPATSGTEP<br>SGTSTEPSEPGSAGSEPATSGTE<br>PSGSGASEPTSTEPGTSTEPSEPG<br>SAGSEPATSGTEPSGSGASEPTS<br>TEPGTSTEPSEPGSAGSGASEPT<br>STEPGSEPATSGTEPSGSGASEP<br>TSTEPGSEPATSGTEPSGSGASE<br>PTSTEPGTSTEPSEPGSAGSEPAT<br>SGTEPSGSGASEPTSTEPGTSTEP<br>SEPGSAGSEPATSGTEPSGTSTE<br>PSEPGSAGSEPATSGTEPSGTST<br>EPSEPGSAGTSTEPSEPGSAGTS<br>TEPSEPGSAGTSTEPSEPGSAGT<br>STEPSEPGSAGTSTEPSEPGSAG<br>TSEPSTSEPGAGSGASEPTSTEP<br>GTSTEPSEPGSAGTSTEPSEPGS<br>AGTSTEPSEPGSAGSEPATSGTE<br>PSGSGASEPTSTEPGSEPATSGT<br>EPSGSEPATSGTEPSGSEPATSG<br>TEPSGSEPATSGTEPSGTSEPSTS<br>EPGAGSEPATSGTEPSGSGASEP<br>TSTEPGTSTEPSEPGSAGSEPATS<br>GTEPSGSGASEPTSTEPGTSTEPS<br>EPGSA | | Residue totals: H: 0 E: 0<br>percent: H: 0 E: 0 | 99.77% |
| | 781 | ASPAAPAPASPAAPAPSAPAAA<br>PASPAPAAPSAPAPAAPSAASPA<br>APSAPPAAASPAAPSAPPAASA<br>AAPAAASAAASAPSAAA | 84 | Residue totals: H: 58 E: 0<br>percent: H: 69.0 E: 0.0 | 78.57% |

*H: alpha-helix E: beta-sheet

Example 73

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide.

The results, shown in Table 33, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 782), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

Conclusions:

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 33

Subsequence score calculations of polypeptide sequences

| Seq Name | SEQ ID NO: | Amino Acid Sequence | Score |
|---|---|---|---|
| J288 | 783 | GSGGEGGSGGEGGSGGEGGSGEGGSGGEGGSGGEGGSGGEGGSGGEG<br>GSGGEGGSGGEGGSGGEGGSGEGGSGGEGGSGGEGGSGGEGGSGGEG<br>GSGGEGGSGGEGGSGGEGGSGEGGSGGEGGSGGEGGSGGEGGSGGEG<br>GSGGEGGSGGEGGSGGEGGSGEGGSGGEGGSGGEGGSGGEGGSGGEG<br>GSGGEGGSGGEGGSGGEGGSGEGGSGGEGGSGGEGGSGGEGGSGGEG<br>GSGGEGGSGGEGGSGGEGGSGEGGSGGEGGSGGEGGSGGEGGSGGEG | 33.3 |
| K288 | 784 | GEGEGGGEGGEGEGGGEGGEGEGGGEGGEGEGGGEGGEGEGGGEGGEG<br>EGGGEGGEGEGGGEGGEGEGGGEGGEGEGGGEGGEGEGGGEGGEGEGG<br>GEGGEGEGGGEGGEGEGGGEGGEGEGGGEGGEGEGGGEGGEGEGGGEG<br>GEGEGGGEGGEGEGGGEGGEGEGGGEGGEGEGGGEGGEGEGGGEGGEG<br>EGGGEGGEGEGGGEGGEGEGGGEGGEGEGGGEGGEGEGGGEGGEGEGG<br>GEGGEGEGGGEGGEGEGGGEGGEGEGGGEGGEGEGGGEGGEGEGGGEG | 46.9 |
| L288 | 785 | SSESSESSSSESSSESSESSSSESSSESSESSSSESSSESSESSSSESSSESSSS<br>ESSSESSESSSSESSSESSESSSSESSSESSESSSSESSSESSESSSSESSESS<br>SSESSSESSESSSSESSSESSESSSSESSSESSESSSSESSSESSSSESSSESSE<br>SSSSESSSESSESSSSESSSESSESSSSESSSESSESSSSESSSESSSSESSSES<br>SESSSSESSSESSSSESSSSESSSESSSESSSSESSSESSESSSSESSSESSSSES | 50.0 |
| Y288 | 786 | GEGSGEGSEGSEGSEGSGEGEGSEGSGEGEGGSEGSEGEGGSEGSEGEGGSE<br>GSEGEGSGEGSEGEGGSEGSEGEGSGEGSEGEGSEGSGEGEGGSEGSEGEG<br>SGEGSEGEGGEGGSEGEGSEGSGEGEGSGEGSEGEGSEGSGEGEGSGEGSE<br>GEGSEGSGEGEGSEGSGEGEGGSEGSEGEGSEGSGEGEGGEGSGEGEGSG<br>EGSEGEGGGEGSEGEGSGEGSGEGEGGSEGGEGSEGGSEGGEGEGSEGSGEG<br>EGSEGGSEGEGSEGGSEGEGSEGSGEGEGSEGSGE | 26.8 |
| Q576 | 787 | GGKPGEGGKPEGGGGKPGGKPEGEGEGKPGGKPEGGGKPGGGEGGKPE<br>GGKPEGEGKPGGGEGKPGGKPEGGGGKPEGEGKPGGGGKPGGKPEGE<br>GKPGGGEGGKPEGKPGEGGEGKPGGKPEGGGEGKPGGGKPGEGGKPGE<br>GKPGGGEGGKPEGGKPEGEGKPGGGEGKPGGKPGEGGKPEGGGEGKPG<br>GKPGEGGEGKPGGGKPEGEGKPGGGKPGGGEGGKPEGEGKPGGKPEGG<br>GEGKPGGKPEGGGKPEGGGEGKPGGGKPGEGGKPGEGEGKPGGKPEGEG<br>KPGGEGGGKPEGKPGGGEGGKPEGGKPGEGGKPEGGKPGEGGEGKPGG<br>GKPGEGGKPEGGGKPEGEGKPGGGGKPGEGGKPEGGKPEGGGEGKPGG<br>GKPEGEGKPGGGEGKPGGKPEGGGGKPGEGGKPEGGKPGGEGGGKPEGE<br>GKPGGKPGEGGGGKPGGKPEGEGKPGEGGEGKPGGKPEGGGEGKPGGKP<br>EGGGEGKPGGGKPGEGGKPEGGGKPGEGGKPGEGGKPEGEGKPGGGEG<br>KPGGKPGEGGKPEGGGEGKPGGKPGGEGGGKPEGGKPGEGGKPEG | 18.5 |
| U576 | 788 | GEGKPGGKPGSGGGKPGEGGKPGSGEGKPGGKPGSGGSGKPGGKPGEGG<br>KPEGGSGGKPGGGGKPGGKPGGEGSGKPGGKPEGGGKPEGGSGGKPGGK<br>PEGGSGGKPGGKPGSGEGGKPGGGKPGGEGKPGSGKPGGEGSGKPGGKP<br>EGGSGGKPGGKPEGGSGGKPGGSGKPGGKPGEGGKPEGGSGGKPGGSGK<br>PGGKPEGGGSGKPGGKPGEGGKPGSGEGGKPGGGKPGGEGKPGSGKPGG<br>EGSGKPGGKPGSGGEGKPGGKPEGGSGGKPGGGKPGGEGKPGSGGKPGE<br>GGKPGSGGGKPGGKPGGEGEGKPGGKPGEGGKPGGEGSGKPGGGGKPG<br>GKPGGEGGKPEGSGKPGGGSGKPGGKPEGGGGKPEGSGKPGGGGKPEGS<br>GKPGGGKPEGGSGGKPGGSGKPGGKPGEGGGKPEGSGKPGGGSGKPGGK<br>PEGGGKPEGGSGGKPGGKPEGGSGGKPGGKPGGEGSGKPGGKPGSGEGG<br>KPGGKPGEGSGGKPGGKPEGGSGGKPGGSGKPGGKPEGGGSGKPGGKPG<br>EGGKPGGEGSGKPGGSGKPG | 18.1 |
| W576 | 789 | GGSGKPGKPGGSGSGKPGSGKPGGGSGKPGSGKPGGGSGKPGSGKPGGG<br>SGKPGSGKPGGGGKPGSGSGKPGGGKPGGSGKPGGGSGKPGKPGSGGS<br>GKPGSGKPGGGSGGKPGKPGSGGSGGKPGKPGSGGGSGKPGKPGSGGSG | 23.4 |

TABLE 33-continued

Subsequence score calculations of polypeptide sequences

| Seq Name | SEQ ID NO: | Amino Acid Sequence | Score |
|---|---|---|---|
| | | GKPGKPGSGGSGGKPGKPGSGGSGKPGSGKPGGGSGKPGSGKPGSGGSG<br>KPGKPGSGGSGKPGSGKPGSGSGKPGSGKPGGGSGKPGSGKPGSGGSGKP<br>GKPGSGGGKPGSGSGKPGGGKPGSGSGKPGGGKPGGSGGKPGGSGGKPG<br>KPGSGGGSGKPGKPGSGGGSGKPGKPGGSGSGKPGSGKPGGGSGKPGSG<br>KPGSGGSGKPGKPGSGGSGKPGKPGSGGGKPGSGSGKPGGGKPGSGSG<br>KPGGGKPGSGSGKPGGGKPGSGSGKPGGSGKPGSGKPGGGSGGKPGKPG<br>SGGSGKPGSGKPGSGGSGKPGKPGGSGSGKPGSGKPGGGSGKPGSGKPG<br>GGSGKPGSGKPGGGSGKPGSGKPGGGGKPGSGSGKPGSGGSGGKPGKPGSG<br>GSGGKPGKPGSGGSGKPGSGKPGGGSGGKPGKPGSGG | |
| Y576 | 790 | GEGSGEGSEGEGSEGSGEGEGSEGSGEGEGGSEGSEGEGSEGSGEGEGGE<br>GSGEGEGSGEGSEGEGGGEGSEGEGSGEGGEGEGSEGGSEGGEGSEGGEG<br>EGSEGSGEGEGSEGGSEGEGSEGGSEGEGSEGSGEGEGSEGSGEGEGSEGS<br>GEGEGSEGSGEGEGSEGGSEGEGGSEGSEGEGSGEGSEGEGGSEGSEGEG<br>GGEGSEGEGSGEGSEGEGGSEGSEGEGGSEGSEGEGGEGSGEGEGSEGSG<br>EGEGSGEGSEGEGSEGSGEGEGSEGSEGEGGSEGSEGEGSEGSEGEGSE<br>GSGEGEGSEGSGEGEGGSEGSEGEGGSEGSEGEGGSEGSEGEGGEGSGEG<br>EGSEGSGEGEGSGEGSEGEGSEGSGEGEGSEGSGEGEGGSEGSEGEGSEGS<br>GEGEGGEGSGEGEGSGEGSEGEGGGEGSEGEGSEGSGEGEGSEGSGEGEG<br>SEGGSEGEGSEGSEGSEGGSEGEGSEGSEGEGSEGSGEGEGSEGSGE<br>GEGSGEGSEGEGGSEGGEGEGSEGGSEGEGSEGEGGGEGSGEGEGGG<br>EGSEGEGSEGSGEGEGSGEGSE | 15.7 |
| AD576 | 791 | GSSESGSSEGGPGSGGEPSESGSSGGSSESGSSEGGPGSSESGSSEGGPGSSES<br>GSSEGGPGSSESGSSEGGPGSSESGSSEGGPGESPGGSSGSESGSSEGGPG<br>ESSGSSESGSSEGGPGSSESGSSEGGPGSSESGSSEGGPGSGGEPSESGSSGE<br>SPGGSSGSESGESPGGSSGSESGSGGEPSESGSSGSSESGSSEGGPGSGGEPS<br>ESGSSGSGGEPSESGSSGSGGEPSESGSSGESSGPGESSGESPGGSSGESPGGSSESGSS<br>GSGGEPSESGSSGSGGEPSESGSSGSSESGSSEGGPGESPGGSSGSESGESPG<br>GSSGSESGESPGGSSGSESGESPGGSSGSESGESPGGSSGSESGSSESGSSEG<br>GPGSGGEPSESGSSGSESGSSGPGESSGSSESGSSEGGPGSGGEPSESGSSGSS<br>ESGSSEGGPGSGGEPSESGSSGESPGGSSGSESGESPGGSSGSESGSSESGSS<br>EGGPGSGGEPSESGSSGSSESGSSEGGPGSGGEPSESGSSGSGGEPSESGSS<br>GESPGGSSGSESGESGSSGPGESSGGSSESGSSEGGPGSEGSSGPGESS | 13.6 |
| AE576 | 792 | AGSPAGSPTSTEEGTSESATPESGPGTSTEPSEGSAPGSPAGSPTSTEEGTST<br>EPSEGSAPGTSTEPSEGSAPGTSESATPESGPGSEPATSGSETPGSEPATSGS<br>ETPGSPAGSPTSTEEGTSESATPESGPGTSTEPSEGSAPGTSTEPSEGSAPGS<br>PAGSPTSTEEGTSTEPSEGSAPGTSTEPSEGSAPGTSESATPESGPGTSTEPSE<br>GSAPGTSESATPESGPGSEPATSGSETPGTSTEPSEGSAPGTSTEPSEGSAPG<br>TSESATPESGPGTSESATPESGPGSPAGSPTSTEEGTSESATPESGPGSEPAT<br>SGSETPGTSESATPESGPGTSTEPSEGSAPGTSTEPSEGSAPGTSTEPSEGSA<br>PGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGS<br>ETPGTSESATPESGPGTSTEPSEGSAPGTSESATPESGPGSPAGSPTSTEEGS<br>PAGSPTSTEEGSPAGSPTSTEEGTSESATPESGPGTSTEPSEGSAP | 6.1 |
| AF540 | 793 | GSTSSTAESPGPGSTSSTAESPGPGSTSESPSGTAPGSTSSTAESPGPGSTSST<br>AESPGPGTSTPESGSASPGSTSESPSGTAPGTSPSGESSTAPGSTSESPSGTAP<br>GSTSESPSGTAPGTSPSGESSTAPGSTSESPSGTAPGSTSESPSGTAPGTSPSG<br>ESSTAPGSTSESPSGTAPGSTSESPSGTAPGSTSESPSGTAPGTSTPESGSASP<br>GSTSESPSGTAPGTSTPESGSASPGSTSSTAESPGPGSTSSTAESPGPGTSTPE<br>SGSASPGTSTPESGSASPGSTSESPSGTAPGTSTPESGSASPGTSTPESGSASP<br>GSTSESPSGTAPGSTSESPSGTAPGSTSESPSGTAPGSTSSTAESPGPGTSTPE<br>SGSASPGTSTPESGSASPGSTSESPSGTAPGSTSESPSGTAPGTSTPESGSASP<br>GSTSESPSGTAPGSTSESPSGTAPGTSTPESGSASPGTSPSGESSTAPGSTSST<br>AESPGPGTSPSGESSTAPGSTSSTAESPGPGTSTPESGSASPGTSESPSGTAP | 8.8 |
| AF504 | 794 | GASPGTSSTGSPGSSPSASTGTGPGSSPSASTGTGPGTPGSGTASSSPGSSTP<br>SGATGSPGSNPSASTGTGPGASPGTSSTGSPGTPGSGTASSSPGSSTPGSNPSAS<br>GSPGTPGSGTASSSPGASPGTSSTGSPGASPGTSSTGSPGTPGSGTASSSPGS<br>STPSGATGSPGASPGTSSTGSPGTPGSGTASSSPGSSTPGSGPGSNPSAS<br>TGTGPGSSPSASTGTGPGSSTPSGATGSPGSSTPSGATGSPGASPGTSSTGSP<br>GASPGTSSTGSPGASPGTSSTGSPGTPGSGTASSSPGASPGTSSTGSPGASPG<br>TSSTGSPGASPGTSSTGSPGSSPSASTGTGPGTPGSGTASSSPGASPGTSSTG<br>SPGASPGTSSTGSPGASPGTSSTGSPGSSTPSGATGSPGSSTPSGATGSPGAS<br>PGTSSTGSPGTPGSGTASSSPGSSTPSGATGSPGSSTPSGATGSPGSSTPSGA<br>TGSPGSSPSASTGTGPGASPGTSSTGSP | 7.0 |
| AE864 | 795 | GSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSE<br>TPGSPAGSPTSTEEGTSESATPESGPGTSTEPSEGSAPGTSTEPSEGSAPGSP<br>AGSPTSTEEGTSTEPSEGSAPGTSTEPSEGSAPGTSESATPESGPGTSTEPSE<br>GSAPGTSESATPESGPGSEPATSGSETPGTSTEPSEGSAPGTSTEPSEGSAPG<br>TSESATPESGPGTSESATPESGPGSPAGSPTSTEEGTSESATPESGPGSEPAT | 6.1 |

TABLE 33-continued

Subsequence score calculations of polypeptide sequences

| Seq Name | SEQ ID NO: | Amino Acid Sequence | Score |
|---|---|---|---|
| | | SGSETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSTEEGTST EPSEGSAPGTSESATPESGPGSEPATSGSETPGTSESATPESGPGSEPATSGS ETPGTSESATPESGPGTSTEPSEGSAPGTSESATPESGPGSPAGSPTSTEEGS PAGSPTSTEEGSPAGSPTSTEEGTSESATPESGPGTSTEPSEGSAPGTSESAT PESGPGSEPATSGSETPGTSESATPESGPGSEPATSGSETPGTSESATPESGP GTSTEPSEGSAPGSPAGSPTSTEEGTSESATPESGPGSEPATSGSETPGTSES ATPESGPGSPAGSPTSTEEGSPAGSPTSTEEGTSTEPSEGSAPGTSESATPES GPGTSESATPESGPGTSESATPESGPGSEPATSGSETPGSEPATSGSETPGSP AGSPTSTEEGTSTEPSEGSAP | |
| AF864 | 796 | GSTSESPSGTAPGTSPSGESSTAPGSTSESPSGTAPGSTSESPSGTAPGTSTPE SGSASPGTSTPESGSASPGSTSESPSGTAPGSTSESPSGTAPGTSPSGESSTAP GSTSESPSGTAPGTSPSGESSTAPGTSPSGESSTAPGSTSSTAESPGPGTSPSG ESSTAPGTSPSGESSTAPGSTSSTAESPGPGTSTPESGSASPGTSTPESGSASP GSTSESPSGTAPGSTSESPSGTAPGTSTPESGSASPGSTSSTAESPGPGTSTPE SGSASPGSTSESPSGTAPGTSPSGESSTAPGSTSSTAESPGPGTSPSGESSTAP GTSTPESGSASPGSTSSTAESPGPGTSSTAESPGPGSTSSTAESPGPGTSSST AESPGPGTSPSGESSTAPGSTSESPSGTAPGSTSESPSGTAPGTSTPESGPXX XGASASGAPSTXXXXSESPSGTAPGSTSESPSGTAPGSTSESPSGTAPGSTS ESPSGTAPGSTSESPSGTAPGSTSESPSGTAPGTSTPESGSASPGTSPSGESST APGTSPSGESSTAPGSTSSTAESPGPGTSPSGESSTAPGTSTPESGSASPGSTS ESPSGTAPGSTSESPSGTAPGTSPSGESSTAPGSTSESPSGTAPGTSTPESGS ASPGTSTPESGSASPGSTSESPSGTAPGTSTPESGSASPGSTSSTAESPGPGST SESPSGTAPGSTSESPSGTAPGTSPSGESSTAPGSTSSTAESPGPGTSPSGESS TAPGTSTPESGSASPGTSPSGESSTAPGTSPSGESSTAPGTSPSGESSTAPGS TSSTAESPGPGTSSTAESPGPGTSPSGESSTAPGSSPSASTGTGPGSSTPSG ATGSPGSSTPSGATGSP | 7.5 |
| AG868 | 797 | GGSPGASPGTSSTGSPGSSPSASTGTGPGSSPSASTGTGPGTPGSGTASSSPG SSTPSGATGSPGSNPSASTGTGPGASPGTSSTGSPGTPGSGTASSSPGSSTPS GATGSPGTPGSGTASSSPGASPGTSSTGSPGTPGSGTASSSPGSSTPSGATGSPGSN PSASTGTGPGSSPSASTGTGPGSSTPSGATGSPGSSTPSGATGSPGASPGTSS TGSPGASPGTSSTGSPGASPGTSSTGSPGTPGSGTASSSPGASPGTSSTGSPG ASPGTSSTGSPGASPGTSSTGSPGSSPSASTGTGPGTPGSGTASSSPGASPGT SSTGSPGASPGTSSTGSPGASPGTSTGSPGSSTPSGATGSPGSSTPSGATGS PGASPGTSSTGSPGTPGSGTASSSPGSSTPSGATGSPGSSTPSGATGSPGSST PSGATGSPGSSPSASTGTGPGASPGTSSTGSPGASPGTSSTGSPGTPGSGTA SSSPGASPGTSSTGSPGASPGTSSTGSPGASPGTSSTGSPGASPGTSSTGSPG TPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSP SASTGTGPGASPGTSSTQSPGASPGTSSTGSPGSSTPSGATGSPGSSPSASTG TGPGASPGTSSTGSPGSSPSASTGTGPGTPGSGTASSSPGSSTPSGATGSPGS STPSGATGSPGASPGTSSTGSP | 7.5 |
| AM875 | 798 | GTSTEPSEGSAPGSEPATSGSETPGSPAGSPTSTEEGSTSSTAESPGPGTSTP ESGSASPGSTSESPSGTAPGSTSESPSGTAPGTSTPESGSASPGTSPESGSAS PGSEPATSGSETPGTSESATPESGPGSPAGSPTSTEEGTSTEPSEGSAPGTSE SATPESGPGTSTEPSEGSAPGTSTEPSEGSAPGSPAGSPTSTEEGTSTEPSEG SAPGTSTEPSEGSAPGTSESATPESGPGTSESATPESGPGTSTEPSEGSAPGT STEPSEGSAPGTSESATPESGPGTSTEPSEGSAPGSEPATSGSETPGSPAGSP TSTEEGSSTPSGATGSPGTPGSGTASSSPGSSTPSGATGSPGTSTEPSEGSAP GTSTEPSEGSAPGSEPATSGSETPGSPAGSPTSTEEGSPAGSPTSTEEGTSTE PSEGSAPGASASGAPSTGGTSESATPESGPGSPAGSPTSTEEGSPAGSPTSTE EGTSSTAESPGPGTSESPSGTAPGTSPSGESSTAPGTPGSGTASSSPGSSTP SGATGSPGSSPSASTGTGPGSEPATSGSETPGTSESATPESGPGSEPATSGSE TPGSTSSTAESPGPGSTSSTAESPGPGTSPSGESSTAPGSEPATSGSETPGSEP ATSGSETPGTSTEPSEGSAPGSTSSTAESPGPGTSTPESGSASPGSTSESPSGT APGTSTEPSEGSAPGTSTEPSEGSAPGTSTEPSEGSAPGSSTPSGATGSPGSS PSASTGTGPGASPGTSSTGSPGSEPATSGSETPGTSESATPESGPGSPAGSPT STEEGSSTPSGATGSPGSSPSASTGTGPGASPGTSSTGSPGTSESATPESGPG TSTEPSEGSAPGTSTEPSEGSAP | 4.5 |
| AM1296 | 799 | GTSTEPSEGSAPGSEPATSGSETPGSPAGSPTSTEEGSTSSTAESPGPGTSTP ESGSASPGSTSESPSGTAPGSTSESPSGTAPGTSTPESGSASPGTSTPESGSAS PGSEPATSGSETPGTSESATPESGPGSPAGSPTSTEEGTSTEPSEGSAPGTSE SATPESGPGTSTEPSEGSAPGTSTEPSEGSAPGSPAGSPTSTEEGTSTEPSEG SAPGTSTEPSEGSAPGTSESATPESGPGTSESATPESGPGTSTEPSEGSAPGT STEPSEGSAPGTSESATPESGPGTSTEPSEGSAPGSEPATSGSETPGSPAGSP TSTEEGSSTPSGATGSPGTPGSGTASSSPGSSTPSGATGSPGTSTEPSEGSAP GTSTEPSEGSAPGSEPATSGSETPGSPAGSPTSTEEGSPAGSPTSTEEGTSTE PSEGSAPGPEPTGPAPSGGSEPATSGSETPGTSESATPESGPGSPAGSPTSTE EGTSESATPESGPGSPAGSPTSTEEGSPAGSPTSTEEGTSESATPESGPGSPA | 4.5 |

TABLE 33-continued

Subsequence score calculations of polypeptide sequences

| Seq Name | SEQ ID NO: | Amino Acid Sequence | Score |
|---|---|---|---|
| | | GSPTSTEEGSPAGSPTSTEEGSTSSTAESPGPGSTSESPSGTAPGTSPSGESST | |
| | | APGSTSESPSGTAPGSTSESPSGTAPGTSPSGESSTAPGTSTEPSEGSAPGTS | |
| | | ESATPESGPGTSESATPESGPGSEPATSGSETPGTSESATPESGPGTSESATP | |
| | | ESGPGTSTEPSEGSAPGTSESATPESGPGTSTEPSEGSAPGTSPSGESSTAPG | |
| | | TSPSGESSTAPGTSPSGESSTAPGTSTEPSEGSAPGSPAGSPTSTEEGTSTEPS | |
| | | EGSAPGSSPSASTGTGPGSSTPSGATGSPGSSTPSGATGSPGSSTPSGATGSP | |
| | | GSSTPSGATGSPGASPGTSSTGSPGASASGAPSTGGTSPSGESSTAPGSTSST | |
| | | AESPGPGTSPSGESSTAPGTSESATPESGPGTSTEPSEGSAPGTSTEPSEGSA | |
| | | PGSSPSASTGTGPGSSTPSGATGSPGASPGTSSTGSPGTSTPESGSASPGTSP | |
| | | SGESSTAPGTSPSGESSTAPGTSESATPESGPGSEPATSGSETPGTSTEPSEG | |
| | | SAPGSTSESPSGTAPGSTSESPSGTAPGTSTPESGSASPGSPAGSPTSTEEGT | |
| | | SESATPESGPGTSTEPSEGSAPGSPAGSPTSTEEGTSESATPESGPGSEPATS | |
| | | GSETPGSSTPSGATGSPGASPGTSSTGSPGSSTPSGATGSPGSTSESPSGTAP | |
| | | GTSPSGESSTAPGSTSSTAESPGPGSSTPSGATGSPGASPGTSSTGSPGTPGS | |
| | | GTASSSPGSPAGSPTSTEEGSPAGSPTSTEEGTSTEPSEGSAP | |

Example 74

Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 34 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 34 were added. The HLA*0101B score of a 9mer peptide with the sequence FDKLPRTSG (SEQ ID NO: 800) would be the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 35-38 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY (SEQ ID NO: 801)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

Lengthy table referenced here

US09371369-20160621-T00001

Please refer to the end of the specification for access instructions.

Lengthy table referenced here

US09371369-20160621-T00002

Please refer to the end of the specification for access instructions.

Lengthy table referenced here

US09371369-20160621-T00003

Please refer to the end of the specification for access instructions.

Lengthy table referenced here

US09371369-20160621-T00004

Please refer to the end of the specification for access instructions.

Lengthy table referenced here

US09371369-20160621-T00005

Please refer to the end of the specification for access instructions.

Lengthy table referenced here

US09371369-20160621-T00006

Please refer to the end of the specification for access instructions.

Lengthy table referenced here

US09371369-20160621-T00007

Please refer to the end of the specification for access instructions.

| Lengthy table referenced here |
| --- |
| US09371369-20160621-T00008 |
| Please refer to the end of the specification for access instructions. |

| Lengthy table referenced here |
| --- |
| US09371369-20160621-T00010 |
| Please refer to the end of the specification for access instructions. |

| Lengthy table referenced here |
| --- |
| US09371369-20160621-T00009 |
| Please refer to the end of the specification for access instructions. |

| Lengthy table referenced here |
| --- |
| US09371369-20160621-T00011 |
| Please refer to the end of the specification for access instructions. |

LENGTHY TABLES

The patent contains a lengthy table section. A copy of the table is available in electronic form from the USPTO web site (http://seqdata.uspto.gov/?pageRequest=docDetail&DocID=US09371369B2). An electronic copy of the table will also be available from the USPTO upon request and payment of the fee set forth in 37 CFR 1.19(b)(3).

SEQUENCE LISTING (1823 sequences)

SEQ ID NO: 1 - protein, 52 aa, Unknown
  Description of Unknown: Adrenomedullin sequence
YRQSMNNFQGLRSFGCRFGTCTVQKLAHQIYQFTDKDKDNVAPRSKISPQGY

SEQ ID NO: 2 - protein, 37 aa, Rattus sp.
KCNTATCATQRLANFLVRSSNNLGPVLPPTNVGSNTY

SEQ ID NO: 3 - protein, 37 aa, Homo sapiens [sequence omitted]

SEQ ID NO: 4 - protein, 32 aa, Homo sapiens
CGNLSTCMLGTYTQDFNKFHTFPQTAIGVGAP

SEQ ID NO: 5 - protein, 32 aa, Oncorhynchus sp.
CSNLSTCVLGKLSQELHKLQTYPRTNTGSGTP

SEQ ID NO: 6 - protein, 36 aa, Homo sapiens
ACDTATCVTHRLAGLLSRSGGVVKNMVPTNVGSKAF

SEQ ID NO: 7 - protein, 37 aa, Homo sapiens
ACNTATCVTHRLAGLLSRSGGMVKSNFVPTNVGSKAF

SEQ ID NO: 8 - protein, 115 aa, Unknown
  Description of Unknown: Cholecystokinin sequence
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 9 - protein, 33 aa, Unknown
  Description of Unknown: Cholecystokinin-33 sequence
KAPSGRMSIVKNLQNLDPSHRISDRDYMGWMDF

SEQ ID NO: 10 - protein, 8 aa, Unknown [sequence omitted]

SEQ ID NO: 11 - protein, 39 aa, Heloderma horridum
HSDGTFTSDLSKQMEEEAVRLFIEWLKNGGPSSGAPPPS

SEQ ID NO: 12 - protein, 39 aa, Heloderma suspectum
HGEGTFTSDLSKQMEEEAVRLFIEWLKNGGPSSGAPPPS

SEQ ID NO: 13 - protein, 216 aa, Unknown
  Description of Unknown: Fibroblast growth factor-19 sequence
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 14 - protein, 209 aa, Unknown
  Description of Unknown: Fibroblast growth factor-21 sequence
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 15 - protein, 34 aa, Unknown
  Description of Unknown: Gastrin sequence
QLGPQGPPHLVADPSKKQGPWLEEEEEAYGWMDF

SEQ ID NO: 16 - protein, 22 aa, Unknown
  Description of Unknown: Gastrin-17 sequence
DPSKKQGPWLEEEEEAYGWMDF

SEQ ID NO: 17 - protein, 42 aa, Unknown
  Description of Unknown: Gastric inhibitory polypeptide sequence
YAEGTFISDYSIAMDKIHQQDFVNWLLAQKGKKNDWKHNITQ

SEQ ID NO: 18 - protein, 28 aa, Unknown
  Description of Unknown: Ghrelin sequence
GSSFLSPEHQRVQQRKESKKPPAKLQPR

SEQ ID NO: 19 - protein, 29 aa, Unknown
  Description of Unknown: Glucagon sequence
HSQGTFTSDYSKYLDSRRAQDFVQWLMNT

SEQ ID NO: 20 - protein, 37 aa, Homo sapiens
HDEFERHAEGTFTSDVSSTLEGQAALEFIAWLVKGRG

SEQ ID NO: 21 - protein, 30 aa, Homo sapiens
HAEGTFTSDVSSYLEGQAALEFIAWLVKGR

SEQ ID NO: 22 - protein, 31 aa, Homo sapiens
HAEGTFTSDVSSTLEGQAALEFIAWLVKGRG

SEQ ID NO: 23 - protein, 37 aa, Unknown
  Description of Unknown: Frog glucagon like peptide-1 sequence
HAEGTYTNDVTEYLEEKAAKEFIEWLIKGKPKKIRYS

SEQ ID NO: 24 - protein, 33 aa, Homo sapiens
HADGSFSDEMNTILDNLAARDFINWLIETKITD

SEQ ID NO: 25 - protein, 31 aa, Unknown
  Description of Unknown: Frog glucagon like peptide-2 sequence
HAEGTFTNDMTNYLEEKAAKEFVGWLIKGRP

SEQ ID NO: 26 - protein, 70 aa, Unknown
  Description of Unknown: Insulin-like growth factor-1 sequence
GPETLCGAELVDALQFVCGDRGFYFNKPTGYGSSSRRAPQTGIVDECCFRSCDLRRLEMYCAPLKPAKSA

SEQ ID NO: 27 - protein, 67 aa, Unknown
  Description of Unknown: Insulin-like growth factor-2 sequence
AYRPSETLCGGELVDTLQFVCGDRGFYFSRPASRVSRRSRGIVEECCFRSCDLALLETYCATPAKSE

SEQ ID NO: 28 - protein, 149 aa, Unknown
  Description of Unknown: Islet neogenesis-associated protein sequence
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 29 - protein, 47 aa, Unknown
  Description of Unknown: Intermedin sequence
TQAQLLRVGCVLGTCQVQNLSHRLWQLMGPAGRQDSAPVDPSSPHSY

SEQ ID NO: 30 - protein, 146 aa, Homo sapiens
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 31 - protein, 8 aa, Sus sp.
YFLFRPRN

SEQ ID NO: 32 - protein, 9 aa, Unknown
  Description of Unknown: Neuromedin U-9 sequence
GYFLFRPRN

SEQ ID NO: 33 - protein, 25 aa, Homo sapiens
FRVDEEFQSPFASQSRGYFLFRPRN

SEQ ID NO: 34 - protein, 25 aa, Sus sp.
FKVDEEFQGPIVSQNRRYFLFRPRN

SEQ ID NO: 35 - protein, 33 aa, Homo sapiens
ILQRGSGTAAVDFTKKDHTATWGRPFFLFRPRN

SEQ ID NO: 36 - protein, 23 aa, Rattus sp.
YKVNEYQGPVAPSGGFFLFRPRN

SEQ ID NO: 37 - protein, 37 aa, Unknown
  Description of Unknown: Oxyntomodulin sequence
HSQGTFTSDYSKYLDSRRAQDFVQWLMNTKRNRNNIA

SEQ ID NO: 38 - protein, 36 aa, Homo sapiens
YPIKPEAPGEDASPEELNRYYASLRHYLNLVTRQRY

SEQ ID NO: 39 - protein, 37 aa, Unknown
  Description of Unknown: Pramlintide sequence
KCNTATCATNRLANFLVHSSNNFGPILPPTNVGSNTY

SEQ ID NO: 40 - protein, 40 aa, Homo sapiens
DNPSLSIDLTFHLLRTLLELARTQSQRERAEQNRIIFDSV

SEQ ID NO: 41 - protein, 41 aa, Homo sapiens
IVLSLDVPIGLLQILLEQARARAAREQATTNARILARVGHC

SEQ ID NO: 42 - protein, 38 aa, Homo sapiens
FTLSLDVPTNIMNLLFNIAKAKNLRAQAAANAHLMAQI

SEQ ID NO: 43 - protein, 37 aa, Artificial Sequence; identical to SEQ ID NO: 39
  Description of Artificial Sequence: Synthetic polypeptide

SEQ ID NO: 44 - protein, 37 aa, Artificial Sequence
  Description of Artificial Sequence: Synthetic polypeptide
  MOD_RES (10)..(10): Asn or Gln
  MOD_RES (25)..(25): Ser, Pro or Gly
  MOD_RES (28)..(29): Ser, Pro or Gly
  MOD_RES (37)..(37): Ser, Pro or Gly
KCNTATCATXRLANFLVHSSNNFGXILXXTNVGSNTX

SEQ ID NO: 45 - protein, 37 aa, Artificial Sequence
  Description of Artificial Sequence: Synthetic polypeptide
KCNTATCATNRLANFLVHSSNNFGGILGGTNVGSNTY

SEQ ID NO: 46 - protein, 37 aa, Artificial Sequence; identical to SEQ ID NO: 45
  Description of Artificial Sequence: Synthetic polypeptide
  C-term amidated

SEQ ID NO: 47 - protein, 39 aa, Heloderma suspectum; identical to SEQ ID NO: 12

SEQ ID NO: 48 - protein, 37 aa, Unknown; identical to SEQ ID NO: 23
  Description of Unknown: Frog glucagon like peptide-1 sequence

SEQ ID NO: 49 - protein, 37 aa, Xenopus laevis
HAEGTFTSDVTQQLDEKAAKEFIDWLINGGPSKEIIS

SEQ ID NO: 50 - protein, 33 aa, Xenopus laevis
HAEGTYTNDVTEYLEEKAAKEFIIEWLIKGKPK

SEQ ID NO: 51 - protein, 32 aa, Xenopus laevis
HAEGTFTNDMTNYLEEKAAKEFVGWLIKGRPK

SEQ ID NO: 52 - protein, 27 aa, Mus musculus
HAEGTFISDYSIAMDKIRQQDFVNWLL

SEQ ID NO: 53 - protein, 27 aa, Equus caballus
HAEGTFISDYSIAMDKIRQQDFVNWLL

SEQ ID NO: 54 - protein, 32 aa, Petromyzon marinus
HADGTFTNDMTSYLDAKAARDFVSWLARSDKS

SEQ ID NO: 55 - protein, 30 aa, Anguilla rostrata
HAEGTYTSDVSSYLQDQAAKEFVSWLKTGR

SEQ ID NO: 56 - protein, 30 aa, Anguilla anguilla; identical to SEQ ID NO: 55

SEQ ID NO: 57 - protein, 38 aa, Hydrolagus colliei
HADGIYTSDVASLTDYLKSKRFVESLSNYNKRQNDRRM

SEQ ID NO: 58 - protein, 31 aa, Amia calva
YADAPYISDVYSYLQDQVAKKWLKSGQDRRE

SEQ ID NO: 59 - protein, 28 aa, Unknown
  Description of Unknown: Glucagon like peptide-1 sequence
HADGTYTSDVSSYLQEQAAKDFITWLKS

SEQ ID NO: 60 - protein, 28 aa, Unknown
  Description of Unknown: Glucagon like peptide-1 sequence
HAEGTYTSDVSSYLQDQAAKEFVSWLKT

SEQ ID NO: 61 - protein, 28 aa, Unknown
  Description of Unknown: Glucagon like peptide-1 sequence
HAEGTFTSDVSSYLEGQAAKEFIAWLVK

SEQ ID NO: 62 - protein, 28 aa, Unknown
  Description of Unknown: Glucagon like peptide-1 sequence
HADGTFTSDVSSYLKDQAIKDFVDRLKA

SEQ ID NO: 63 - protein, 28 aa, Unknown
  Description of Unknown: Glucagon like peptide-1 sequence
HADGIYTSDVASLTDYLKSKRFVESLSN

SEQ ID NO: 64 - protein, 28 aa, Unknown
  Description of Unknown: Glucagon like peptide-1 sequence
HSQGTFTSDYSKYLDSRRAQQFLKWLLN

SEQ ID NO: 65 - protein, 28 aa, Unknown
  Description of Unknown: Glucagon like peptide-1 sequence
HSQGTFTSDYSKHLDSRYAQEFVQWLMN

SEQ ID NO: 66 - protein, 28 aa, Unknown
  Description of Unknown: Glucagon like peptide-1 sequence
HSEGTFSNDYSKYLEDRKAQEFVRWLMN

SEQ ID NO: 67 - protein, 28 aa, Unknown
  Description of Unknown: Glucagon like peptide-1 sequence
HTDGIFSSDYSKYLDNRRTKDFVQWLLS

SEQ ID NO: 68 - protein, 28 aa, Unknown
  Description of Unknown: Glucagon like peptide-1 sequence
HSEGTFSSDYSKYLDSRRAKDFVQWLMS

SEQ ID NO: 69 - protein, 28 aa, Unknown
  Description of Unknown: Glucagon like peptide-1 sequence
YAEGTFISDYSIAMDKIRQQDFVNWLLA

SEQ ID NO: 70 - protein, 28 aa, Unknown
  Description of Unknown: Glucagon like peptide-1 sequence
HADGIFTTVYSHLLAKLAVKRYLHSLIR

SEQ ID NO: 71 - protein, 28 aa, Unknown
  Description of Unknown: Glucagon like peptide-1 sequence
HIDGIFTDSYSRYRKQMAVKKYLAAVLG

SEQ ID NO: 72 - protein, 28 aa, Unknown
  Description of Unknown: Glucagon like peptide-1 sequence
HSDALFTDTYTRLRKQMAMKKYLNSVLN

SEQ ID NO: 73 - protein, 28 aa, Unknown
  Description of Unknown: Glucagon like peptide-1 sequence
HSDAVFTDSYTRLLKQMAMRKYLDSILN

SEQ ID NO: 74 - protein, 28 aa, Unknown
  Description of Unknown: Glucagon like peptide-1 sequence
HSDATFTAEYSKLLAKLALQKYLESILG

SEQ ID NO: 75 - protein, 28 aa, Unknown
  Description of Unknown: Glucagon like peptide-1 sequence
YADAIFTNSYRKVLGQLSARKLLQDIMN

SEQ ID NO: 76 - protein, 28 aa, Unknown
  Description of Unknown: Glucagon like peptide-1 sequence
HADAIFTSSYRRILGQLYARKLLHEIMN

SEQ ID NO: 77 - protein, 28 aa, Unknown
  Description of Unknown: Glucagon like peptide-1 sequence
HVDAIFTTNYRKLLSQLYARKVIQDIMN

SEQ ID NO: 78 - protein, 28 aa, Unknown
  Description of Unknown: Glucagon like peptide-1 sequence
VAHGILNEAYRKVLDQLSAGKHLQSLVA

SEQ ID NO: 79 - protein, 28 aa, Unknown
  Description of Unknown: Glucagon like peptide-1 sequence
VAHGILDKAYRKVLDQLSARRYLQTLMA

SEQ ID NO: 80 - protein, 28 aa, Unknown
  Description of Unknown: Glucagon like peptide-1 sequence
HADGMFNKAYRKALGQLSARKYLHSLMA

SEQ ID NO: 81 - protein, 28 aa, Unknown
  Description of Unknown: Glucagon like peptide-1 sequence
HADGSFSDEMNTVLDSLATRDFINWLLQ

SEQ ID NO: 82 - protein, 27 aa, Unknown
  Description of Unknown: Glucagon like peptide-1 sequence
HSDGTFTSELSRLRESARLQRLLQGLV

SEQ ID NO: 83 - protein, 27 aa, Unknown
  Description of Unknown: Glucagon like peptide-1 sequence
HSDGLFTSEYSKMRGNAQVQKFIQNLM

SEQ ID NO: 84 - protein, 28 aa, Unknown
  Description of Unknown: Glucagon like peptide-1 sequence
HSDGTFTSDLSKQMEEEAVRLFIEWLKN

SEQ ID NO: 85 - protein, 31 aa, Artificial Sequence
  Description of Artificial Sequence: Synthetic polypeptide
HAEGTFTSDVSSYLEGQAAREFIAWLVKGRG

SEQ ID NO: 86 - protein, 31 aa, Artificial Sequence
  Description of Artificial Sequence: Synthetic polypeptide
HAEGTFTSDVSSYLEGQAAKEFIAWLVRGRG

SEQ ID NO: 87 - protein, 31 aa, Artificial Sequence
  Description of Artificial Sequence: Synthetic polypeptide
HAEGTFTSDVSSYLEGQAAKEFIAWLVKGKG

SEQ ID NO: 88 - protein, 31 aa, Artificial Sequence
  Description of Artificial Sequence: Synthetic polypeptide
HAEGTFTSDVSSYLEGQAAREFIAWLVRGKG

SEQ ID NO: 89 - protein, 32 aa, Artificial Sequence
  Description of Artificial Sequence: Synthetic polypeptide
HAEGTFTSDVSSYLEGQAAREFIAWLVRGKGR

SEQ ID NO: 90 - protein, 33 aa, Artificial Sequence
  Description of Artificial Sequence: Synthetic polypeptide
HAEGTFTSDVSSYLEGQAAREFIAWLVRGRGRK

SEQ ID NO: 91 - protein, 34 aa, Artificial Sequence
  Description of Artificial Sequence: Synthetic polypeptide
HAEGTFTSDVSSYLEGQAAREFIAWLVRGRGRRK

SEQ ID NO: 92 - protein, 31 aa, Artificial Sequence
  Description of Artificial Sequence: Synthetic polypeptide
HAEGTFTSDVSSYLEGQAAREFIAWLVKGKG

SEQ ID NO: 93 - protein, 31 aa, Artificial Sequence
  Description of Artificial Sequence: Synthetic polypeptide
HAEGTFTSDVSSYLEGQAAKEFIAWLVRGKG

SEQ ID NO: 94 - protein, 33 aa, Artificial Sequence
  Description of Artificial Sequence: Synthetic polypeptide
HAEGTFTSDVSSYLEGQAAREFIAWLVKGRGRK

SEQ ID NO: 95 - protein, 34 aa, Artificial Sequence
  Description of Artificial Sequence: Synthetic polypeptide
HAEGTFTSDVSSYLEGQAAKEFIAWLVRGRGRRK

SEQ ID NO: 96 - protein, 33 aa, Artificial Sequence
  Description of Artificial Sequence: Synthetic polypeptide
HAEGTFTSDVSSYLEGQAAREFIAWLVRGKGRK

SEQ ID NO: 97 - protein, 34 aa, Artificial Sequence
  Description of Artificial Sequence: Synthetic polypeptide
HAEGTFTSDVSSYLEGQAAREFIAWLVRGKGRRK

SEQ ID NO: 98 - protein, 31 aa, Artificial Sequence
  Description of Artificial Sequence: Synthetic polypeptide
HGEGTFTSDVSSYLEGQAAREFIAWLVKGRG

SEQ ID NO: 99 - protein, 31 aa, Artificial Sequence
  Description of Artificial Sequence: Synthetic polypeptide
HGEGTFTSDVSSYLEGQAAKEFIAWLVRGRG

SEQ ID NO: 100 - protein, 31 aa, Artificial Sequence
  Description of Artificial Sequence: Synthetic polypeptide
HGEGTFTSDVSSYLEGQAAKEFIAWLVKGKG

SEQ ID NO: 101 - protein, 31 aa, Artificial Sequence
  Description of Artificial Sequence: Synthetic polypeptide
HGEGTFTSDVSSYLEGQAAREFIAWLVRGKG

SEQ ID NO: 102 - protein, 33 aa, Artificial Sequence
  Description of Artificial Sequence: Synthetic polypeptide
HGEGTFTSDVSSYLEGQAAREFIAWLVRGRGRK

SEQ ID NO: 103 - protein, 34 aa, Artificial Sequence
  Description of Artificial Sequence: Synthetic polypeptide
HGEGTFTSDVSSYLEGQAAREFIAWLVRGRGRRK

SEQ ID NO: 104 - protein, 31 aa, Artificial Sequence
  Description of Artificial Sequence: Synthetic polypeptide
HGEGTFTSDVSSYLEGQAAREFIAWLVKGKG

SEQ ID NO: 105 - protein, 31 aa, Artificial Sequence
  Description of Artificial Sequence: Synthetic polypeptide
HGEGTFTSDVSSYLEGQAAKEFIAWLVRGKG

SEQ ID NO: 106 - protein, 33 aa, Artificial Sequence
  Description of Artificial Sequence: Synthetic polypeptide
HGEGTFTSDVSSYLEGQAAREFIAWLVKGRGRK

SEQ ID NO: 107 - protein, 34 aa, Artificial Sequence
  Description of Artificial Sequence: Synthetic polypeptide
HGEGTFTSDVSSYLEGQAAKEFIAWLVRGRGRRK

SEQ ID NO: 108 - protein, 33 aa, Artificial Sequence
  Description of Artificial Sequence: Synthetic polypeptide
HGEGTFTSDVSSYLEGQAAREFIAWLVRGKGRK

SEQ ID NO: 109 - protein, 34 aa, Artificial Sequence
  Description of Artificial Sequence: Synthetic polypeptide
HGEGTFTSDVSSYLEGQAAREFIAWLVRGKGRRK

SEQ ID NO: 110 - protein, 32 aa, Artificial Sequence
  Description of Artificial Sequence: Synthetic polypeptide
HAEGTFTSDVSSYLEGQAAREFIAWLVRGRGK

SEQ ID NO: 111 - protein, 33 aa, Artificial Sequence; identical to SEQ ID NO: 90
  Description of Artificial Sequence: Synthetic polypeptide

SEQ ID NO: 112 - protein, 34 aa, Artificial Sequence; identical to SEQ ID NO: 91
  Description of Artificial Sequence: Synthetic polypeptide

SEQ ID NO: 113 - protein, 35 aa, Artificial Sequence
  Description of Artificial Sequence: Synthetic polypeptide
HAEGTFTSDVSSYLEGQAAREFIAWLVRGRGRREK

SEQ ID NO: 114 - protein, 36 aa, Artificial Sequence
  Description of Artificial Sequence: Synthetic polypeptide
HAEGTFTSDVSSYLEGQAAREFIAWLVRGRGRREFK

SEQ ID NO: 115 - protein, 37 aa, Artificial Sequence
  Description of Artificial Sequence: Synthetic polypeptide
HAEGTFTSDVSSYLEGQAAREFIAWLVRGRGRREFPK

SEQ ID NO: 116 - protein, 38 aa, Artificial Sequence
  Description of Artificial Sequence: Synthetic polypeptide
HAEGTFTSDVSSYLEGQAAREFIAWLVRGRGRREFPEK

SEQ ID NO: 117 - protein, 39 aa, Artificial Sequence
  Description of Artificial Sequence: Synthetic polypeptide
HAEGTFTSDVSSYLEGQAAREFIAWLVRGRGRREFPEEK

SEQ ID NO: 118 - protein, 38 aa, Artificial Sequence
  Description of Artificial Sequence: Synthetic polypeptide
HDEFERHAEGTFTSDVSSYLEGQAAREFIAWLVRGRGK

SEQ ID NO: 119 - protein, 39 aa, Artificial Sequence
  Description of Artificial Sequence: Synthetic polypeptide
HDEFERHAEGTFTSDVSSYLEGQAAREFIAWLVRGRGRK

SEQ ID NO: 120 - protein, 40 aa, Artificial Sequence
  Description of Artificial Sequence: Synthetic polypeptide
HDEFERHAEGTFTSDVSSYLEGQAAREFIAWLVRGRGRRK

SEQ ID NO: 121 - protein, 41 aa, Artificial Sequence
  Description of Artificial Sequence: Synthetic polypeptide
HDEFERHAEGTFTSDVSSYLEGQAAREFIAWLVRGRGRREK

SEQ ID NO: 122 - protein, 42 aa, Artificial Sequence
  Description of Artificial Sequence: Synthetic polypeptide
HDEFERHAEGTFTSDVSSYLEGQAAREFIAWLVRGRGRREFK

SEQ ID NO: 123 - protein, 43 aa, Artificial Sequence
  Description of Artificial Sequence: Synthetic polypeptide
HDEFERHAEGTFTSDVSSYLEGQAAREFIAWLVRGRGRREFPK

SEQ ID NO: 124 - protein, 44 aa, Artificial Sequence
  Description of Artificial Sequence: Synthetic polypeptide
HDEFERHAEGTFTSDVSSYLEGQAAREFIAWLVRGRGRREFPEK

SEQ ID NO: 125 - protein, 45 aa, Artificial Sequence
  Description of Artificial Sequence: Synthetic polypeptide
HDEFERHAEGTFTSDVSSYLEGQAAREFIAWLVRGRGRREFPEEK

SEQ ID NO: 126 - protein, 38 aa, Artificial Sequence
  Description of Artificial Sequence: Synthetic polypeptide
DEFERHAEGTFTSDVSSYLEGQAAREFIAWLVRGRGRK

SEQ ID NO: 127 - protein, 39 aa, Artificial Sequence
  Description of Artificial Sequence: Synthetic polypeptide
DEFERHAEGTFTSDVSSYLEGQAAREFIAWLVRGRGRRK

SEQ ID NO: 128 - protein, 40 aa, Artificial Sequence
  Description of Artificial Sequence: Synthetic polypeptide
DEFERHAEGTFTSDVSSYLEGQAAREFIAWLVRGRGRREK

SEQ ID NO: 129 - protein, 41 aa, Artificial Sequence
  Description of Artificial Sequence: Synthetic polypeptide
DEFERHAEGTFTSDVSSYLEGQAAREFIAWLVRGRGRREFK

SEQ ID NO: 130 - protein, 42 aa, Artificial Sequence
  Description of Artificial Sequence: Synthetic polypeptide
DEFERHAEGTFTSDVSSYLEGQAAREFIAWLVRGRGRREFPK

SEQ ID NO: 131 - protein, 43 aa, Artificial Sequence
  Description of Artificial Sequence: Synthetic polypeptide
DEFERHAEGTFTSDVSSYLEGQAAREFIAWLVRGRGRREFPEK

SEQ ID NO: 132 - protein, 44 aa, Artificial Sequence
  Description of Artificial Sequence: Synthetic polypeptide
DEFERHAEGTFTSDVSSYLEGQAAREFIAWLVRGRGRREFPEEK

SEQ ID NO: 133 - protein, 36 aa, Artificial Sequence
  Description of Artificial Sequence: Synthetic polypeptide
EFERHAEGTFTSDVSSYLEGQAAREFIAWLVRGRGK

SEQ ID NO: 134 - protein, 37 aa, Artificial Sequence
  Description of Artificial Sequence: Synthetic polypeptide
EFERHAEGTFTSDVSSYLEGQAAREFIAWLVRGRGRK

SEQ ID NO: 135 - protein, 38 aa, Artificial Sequence
  Description of Artificial Sequence: Synthetic polypeptide
EFERHAEGTFTSDVSSYLEGQAAREFIAWLVRGRGRRK

SEQ ID NO: 136 - protein, 39 aa, Artificial Sequence
  Description of Artificial Sequence: Synthetic polypeptide
EFERHAEGTFTSDVSSYLEGQAAREFIAWLVRGRGRREK

SEQ ID NO: 137 - protein, 40 aa, Artificial Sequence
  Description of Artificial Sequence: Synthetic polypeptide
EFERHAEGTFTSDVSSYLEGQAAREFIAWLVRGRGRREFK

SEQ ID NO: 138 - protein, 41 aa, Artificial Sequence
  Description of Artificial Sequence: Synthetic polypeptide
EFERHAEGTFTSDVSSYLEGQAAREFIAWLVRGRGRREFPK

SEQ ID NO: 139 - protein, 42 aa, Artificial Sequence
  Description of Artificial Sequence: Synthetic polypeptide
EFERHAEGTFTSDVSSYLEGQAAREFIAWLVRGRGRREFPEK

SEQ ID NO: 140 - protein, 43 aa, Artificial Sequence
  Description of Artificial Sequence: Synthetic polypeptide
EFERHAEGTFTSDVSSYLEGQAAREFIAWLVRGRGRREFPEEK

SEQ ID NO: 141 - protein, 35 aa, Artificial Sequence
  Description of Artificial Sequence: Synthetic polypeptide
FERHAEGTFTSDVSSYLEGQAAREFIAWLVRGRGK

SEQ ID NO: 142 - protein, 36 aa, Artificial Sequence
  Description of Artificial Sequence: Synthetic polypeptide
FERHAEGTFTSDVSSYLEGQAAREFIAWLVRGRGRK

SEQ ID NO: 143 - protein, 37 aa, Artificial Sequence
  Description of Artificial Sequence: Synthetic polypeptide
FERHAEGTFTSDVSSYLEGQAAREFIAWLVRGRGRRK

SEQ ID NO: 144 - protein, 38 aa, Artificial Sequence
  Description of Artificial Sequence: Synthetic polypeptide
FERHAEGTFTSDVSSYLEGQAAREFIAWLVRGRGRREK

SEQ ID NO: 145 - protein, 39 aa, Artificial Sequence
  Description of Artificial Sequence: Synthetic polypeptide
FERHAEGTFTSDVSSYLEGQAAREFIAWLVRGRGRREFK

SEQ ID NO: 146 - protein, 40 aa, Artificial Sequence
  Description of Artificial Sequence: Synthetic polypeptide
FERHAEGTFTSDVSSYLEGQAAREFIAWLVRGRGRREFPK

SEQ ID NO: 147 - protein, 41 aa, Artificial Sequence
  Description of Artificial Sequence: Synthetic polypeptide
FERHAEGTFTSDVSSYLEGQAAREFIAWLVRGRGRREFPEK

SEQ ID NO: 148 - protein, 42 aa, Artificial Sequence
  Description of Artificial Sequence: Synthetic polypeptide
FERHAEGTFTSDVSSYLEGQAAREFIAWLVRGRGRREFPEEK

SEQ ID NO: 149 - protein, 34 aa, Artificial Sequence
  Description of Artificial Sequence: Synthetic polypeptide
ERHAEGTFTSDVSSYLEGQAAREFIAWLVRGRGK

SEQ ID NO: 150 - protein, 35 aa, Artificial Sequence
  Description of Artificial Sequence: Synthetic polypeptide
ERHAEGTFTSDVSSYLEGQAAREFIAWLVRGRGRK

SEQ ID NO: 151 - protein, 36 aa, Artificial Sequence
  Description of Artificial Sequence: Synthetic polypeptide
ERHAEGTFTSDVSSYLEGQAAREFIAWLVRGRGRRK

SEQ ID NO: 152 - protein, 37 aa, Artificial Sequence
  Description of Artificial Sequence: Synthetic polypeptide
ERHAEGTFTSDVSSYLEGQAAREFIAWLVRGRGRREK

SEQ ID NO: 153 - protein, 38 aa, Artificial Sequence
  Description of Artificial Sequence: Synthetic polypeptide
ERHAEGTFTSDVSSYLEGQAAREFIAWLVRGRGRREFK

SEQ ID NO: 154 - protein, 39 aa, Artificial Sequence
  Description of Artificial Sequence: Synthetic polypeptide
ERHAEGTFTSDVSSYLEGQAAREFIAWLVRGRGRREFPK

SEQ ID NO: 155 - protein, 40 aa, Artificial Sequence
  Description of Artificial Sequence: Synthetic polypeptide
ERHAEGTFTSDVSSYLEGQAAREFIAWLVRGRGRREFPEK

SEQ ID NO: 156 - protein, 41 aa, Artificial Sequence
  Description of Artificial Sequence: Synthetic polypeptide
ERHAEGTFTSDVSSYLEGQAAREFIAWLVRGRGRREFPEEK

SEQ ID NO: 157 - protein, 33 aa, Artificial Sequence
  Description of Artificial Sequence: Synthetic polypeptide
RHAEGTFTSDVSSYLEGQAAREFIAWLVRGRGK

SEQ ID NO: 158 - protein, 34 aa, Artificial Sequence
  Description of Artificial Sequence: Synthetic polypeptide
RHAEGTFTSDVSSYLEGQAAREFIAWLVRGRGRK

SEQ ID NO: 159 - protein, 35 aa, Artificial Sequence
  Description of Artificial Sequence: Synthetic polypeptide
RHAEGTFTSDVSSYLEGQAAREFIAWLVRGRGRRK

SEQ ID NO: 160 - protein, 36 aa, Artificial Sequence
  Description of Artificial Sequence: Synthetic polypeptide
RHAEGTFTSDVSSYLEGQAAREFIAWLVRGRGRREK

SEQ ID NO: 161 - protein, 37 aa, Artificial Sequence
  Description of Artificial Sequence: Synthetic polypeptide
RHAEGTFTSDVSSYLEGQAAREFIAWLVRGRGRREFK

SEQ ID NO: 162 - protein, 38 aa, Artificial Sequence
  Description of Artificial Sequence: Synthetic polypeptide
RHAEGTFTSDVSSYLEGQAAREFIAWLVRGRGRREFPK

SEQ ID NO: 163 - protein, 39 aa, Artificial Sequence
  Description of Artificial Sequence: Synthetic polypeptide
RHAEGTFTSDVSSYLEGQAAREFIAWLVRGRGRREFPEK

SEQ ID NO: 164 - protein, 40 aa, Artificial Sequence
  Description of Artificial Sequence: Synthetic polypeptide
RHAEGTFTSDVSSYLEGQAAREFIAWLVRGRGRREFPEEK

SEQ ID NO: 165 - protein, 38 aa, Artificial Sequence
  Description of Artificial Sequence: Synthetic polypeptide
HDEFERHAEGTFTSDVSSYLEGQAAREFIAWLVKGRGK

SEQ ID NO: 166 - protein, 38 aa, Artificial Sequence
  Description of Artificial Sequence: Synthetic polypeptide
HDEFERHAEGTFTSDVSSYLEGQAAKEFIAWLVRGRGK

SEQ ID NO: 167 - protein, 38 aa, Artificial Sequence
  Description of Artificial Sequence: Synthetic polypeptide
HDEFERHAEGTFTSDVSSYLEGQAAREFIAWLVRGKGK

SEQ ID NO: 168 - protein, 32 aa, Artificial Sequence
  Description of Artificial Sequence: Synthetic polypeptide
HAEGTFTSDVSSYLEGQAAREFIAWLVKGRGK

SEQ ID NO: 169 - protein, 32 aa, Artificial Sequence
  Description of Artificial Sequence: Synthetic polypeptide
HAEGTFTSDVSSYLEGQAAKEFIAWLVRGRGK

SEQ ID NO: 170 - protein, 32 aa, Artificial Sequence
  Description of Artificial Sequence: Synthetic polypeptide
HAEGTFTSDVSSYLEGQAAREFIAWLVRGKGK

SEQ ID NO: 171 - protein, 32 aa, Artificial Sequence; identical to SEQ ID NO: 110
  Description of Artificial Sequence: Synthetic polypeptide

SEQ ID NO: 172 - protein, 39 aa, Artificial Sequence
  Description of Artificial Sequence: Synthetic polypeptide
HDEFERHAEGTFTSDVSSYLEGQAAREFIAWLVKGRGRK

SEQ ID NO: 173 - protein, 39 aa, Artificial Sequence
  Description of Artificial Sequence: Synthetic polypeptide
HDEFERHAEGTFTSDVSSYLEGQAAKEFIAWLVRGRGRK

SEQ ID NO: 174 - protein, 39 aa, Artificial Sequence
  Description of Artificial Sequence: Synthetic polypeptide
HDEFERHAEGTFTSDVSSYLEGQAAREFIAWLVRGKGRK

SEQ ID NO: 175 - protein, 33 aa, Artificial Sequence; identical to SEQ ID NO: 94
  Description of Artificial Sequence: Synthetic polypeptide

SEQ ID NO: 176 - protein, 33 aa, Artificial Sequence
  Description of Artificial Sequence: Synthetic polypeptide
HAEGTFTSDVSSYLEGQAAKEFIAWLVRGRGRK

SEQ ID NO: 177 - protein, 33 aa, Artificial Sequence; identical to SEQ ID NO: 96
  Description of Artificial Sequence: Synthetic polypeptide

SEQ ID NO: 178 - protein, 32 aa, Artificial Sequence
  Description of Artificial Sequence: Synthetic polypeptide
HGEGTFTSDVSSYLEGQAAREFIAWLVKGRGK

SEQ ID NO: 179 - protein, 32 aa, Artificial Sequence
  Description of Artificial Sequence: Synthetic polypeptide
HGEGTFTSDVSSYLEGQAAREFIAWLVRGKGK

SEQ ID NO: 180 - protein, 38 aa, Unknown
  Description of Unknown: Neuromedin U sequence
FLFHYSKTQKLGKSNVVEELQSPFASQSRGYFLFRPRN

SEQ ID NO: 181 - protein, 33 aa, Homo sapiens; identical to SEQ ID NO: 35

SEQ ID NO: 182 - protein, 12 aa, Artificial Sequence
  Description of Artificial Sequence: Synthetic peptide
GESPGGSSGSES

SEQ ID NO: 183 - protein, 12 aa, Artificial Sequence
  Description of Artificial Sequence: Synthetic peptide
GSEGSSGPGESS

SEQ ID NO: 184 - protein, 12 aa, Artificial Sequence
  Description of Artificial Sequence: Synthetic peptide
GSSESGSSEGGP

SEQ ID NO: 185 - protein, 12 aa, Artificial Sequence
  Description of Artificial Sequence: Synthetic peptide
GSGGEPSESGSS

SEQ ID NO: 186 - protein, 12 aa, Artificial Sequence
  Description of Artificial Sequence: Synthetic peptide
GSPAGSPTSTEE

SEQ ID NO: 187 - protein, 12 aa, Artificial Sequence
  Description of Artificial Sequence: Synthetic peptide
GSEPATSGSETP

SEQ ID NO: 188 - protein, 12 aa, Artificial Sequence
  Description of Artificial Sequence: Synthetic peptide
GTSESATPESGP

SEQ ID NO: 189 - protein, 12 aa, Artificial Sequence
  Description of Artificial Sequence: Synthetic peptide
GTSTEPSEGSAP

SEQ ID NO: 190 - protein, 12 aa, Artificial Sequence
  Description of Artificial Sequence: Synthetic peptide
GSTSESPSGTAP

SEQ ID NO: 191 - protein, 12 aa, Artificial Sequence
  Description of Artificial Sequence: Synthetic peptide
GTSTPESGSASP

SEQ ID NO: 192 - protein, 12 aa, Artificial Sequence
  Description of Artificial Sequence: Synthetic peptide
GTSPSGESSTAP

SEQ ID NO: 193 - protein, 12 aa, Artificial Sequence
  Description of Artificial Sequence: Synthetic peptide
GSTSSTAESPGP

SEQ ID NO: 194 - protein, 12 aa, Artificial Sequence
  Description of Artificial Sequence: Synthetic peptide
GTPGSGTASSSP

SEQ ID NO: 195 - protein, 12 aa, Artificial Sequence
  Description of Artificial Sequence: Synthetic peptide
GSSTPSGATGSP

SEQ ID NO: 196 - protein, 12 aa, Artificial Sequence
  Description of Artificial Sequence: Synthetic peptide
GSSPSASTGTGP

SEQ ID NO: 197 - protein, 12 aa, Artificial Sequence
  Description of Artificial Sequence: Synthetic peptide
GASPGTSSTGSP

SEQ ID NO: 198 - protein, 12 aa, Artificial Sequence
  Description of Artificial Sequence: Synthetic peptide
GEPAGSPTSTSE

SEQ ID NO: 199 - protein, 12 aa, Artificial Sequence
  Description of Artificial Sequence: Synthetic peptide
GTGEPSSTPASE

SEQ ID NO: 200 - protein, 12 aa, Artificial Sequence
  Description of Artificial Sequence: Synthetic peptide
GSGPSTESAPTE

SEQ ID NO: 201 - protein, 12 aa, Artificial Sequence
  Description of Artificial Sequence: Synthetic peptide
GSETPSGPSETA

SEQ ID NO: 202 - protein, 12 aa, Artificial Sequence
  Description of Artificial Sequence: Synthetic peptide
GPSETSTSEPGA

SEQ ID NO: 203 - protein, 12 aa, Artificial Sequence
  Description of Artificial Sequence: Synthetic peptide
GSPSEPTEGTSA

SEQ ID NO: 204 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 205 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 206 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 207 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 208 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 209 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 210 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 211 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 212 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 213 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 214 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 215 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 216 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 217 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 218 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 219 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 220 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 221 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 222 - protein, 8 aa, Unknown
  Description of Unknown: Thrombin cleavage sequence
LTPRSLLV

SEQ ID NO: 223 - protein, 8 aa, Unknown
  Description of Unknown: Thrombin cleavage sequence
LTPRSLLV

SEQ ID NO: 224 - protein, 8 aa, Unknown
  Description of Unknown: FXIa cleavage sequence
KLTRVVGG

SEQ ID NO: 225 - protein, 8 aa, Unknown
  Description of Unknown: FXIIa cleavage sequence
TMTRIVGG

SEQ ID NO: 226 - protein, 8 aa, Unknown
  Description of Unknown: Kallikrein cleavage sequence
SPFRSTGG

SEQ ID NO: 227 - protein, 8 aa, Unknown
  Description of Unknown: FVIIa cleavage sequence
LQVRIVGG

SEQ ID NO: 228 - protein, 8 aa, Unknown
  Description of Unknown: FIXa cleavage sequence
PLGRIVGG

SEQ ID NO: 229 - protein, 8 aa, Unknown
  Description of Unknown: FXa cleavage sequence
IEGRTVGG

SEQ ID NO: 230 - protein, 8 aa, Unknown
  Description of Unknown: FIIa cleavage sequence
LTPRSLLV

SEQ ID NO: 231 - protein, 8 aa, Unknown
  Description of Unknown: Elastase-2 cleavage sequence
LGPVSGVP

SEQ ID NO: 232 - protein, 8 aa, Unknown
  Description of Unknown: Granzyme-B cleavage sequence
VAGDSLEE

SEQ ID NO: 233 - protein, 8 aa, Unknown
  Description of Unknown: MMP-12 cleavage sequence
GPAGLGGA

SEQ ID NO: 234 - protein, 8 aa, Unknown
  Description of Unknown: MMP-13 cleavage sequence
GPAGLRGA

SEQ ID NO: 235 - protein, 8 aa, Unknown
  Description of Unknown: MMP-17 cleavage sequence
APLGLRLR

SEQ ID NO: 236 - protein, 8 aa, Unknown
  Description of Unknown: MMP-20 cleavage sequence
PALPLVAQ

SEQ ID NO: 237 - protein, 7 aa, Unknown
  Description of Unknown: TEV cleavage sequence
ENLYFQG

SEQ ID NO: 238 - protein, 8 aa, Unknown
  Description of Unknown: Enterokinase cleavage sequence
DDDKIVGG

SEQ ID NO: 239 - protein, 8 aa, Unknown
  Description of Unknown: Protease 3C cleavage sequence
LEVLFQGP

SEQ ID NO: 240 - protein, 8 aa, Unknown
  Description of Unknown: Sortase A cleavage sequence
LPKTGSES

SEQ ID NO: 241 - protein, 8 aa, Unknown
  Description of Unknown: MPP-12 minimal cut site sequence
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 242 - protein, 8 aa, Unknown
  Description of Unknown: MPP-13 minimal cut site sequence
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 243 - protein, 8 aa, Unknown
  Description of Unknown: TEV minimal cut site sequence
ENLYFQGS

SEQ ID NO: 244 - protein, 8 aa, Unknown
  Description of Unknown: Enterokinase minimal cut site sequence
DDDKIVGG

SEQ ID NO: 245 - protein, 8 aa, Unknown
  Description of Unknown: Protease 3C minimal cut site sequence
LEVLFQGP

SEQ ID NO: 246 - protein, 8 aa, Unknown
  Description of Unknown: Sortase A minimal cut site sequence
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 247 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 248 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 249 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 250 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 251 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 252 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 253 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 254 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 255 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctagcccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctagcccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 256 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 257 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 258 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 259 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 260 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 261 - DNA, 37 bp, Artificial Sequence
  Description of Artificial Sequence: Synthetic oligonucleotide
aggtgcaagcgcaagcggcgcgccaagcacgggaggt

SEQ ID NO: 262 - DNA, 37 bp, Artificial Sequence
  Description of Artificial Sequence: Synthetic oligonucleotide
aggtccagaaccaacggggccggccccaagcggaggt

SEQ ID NO: 263 - protein, 6 aa, Artificial Sequence
  Description of Artificial Sequence: Synthetic 6xHis tag
HHHHHH

SEQ ID NO: 264 - protein, 4 aa, Unknown
  Description of Unknown: Enterokinase cleavage site sequence
DDDK

SEQ ID NO: 265 - protein, 4 aa, Unknown
  Description of Unknown: Factor Xa cleavage site sequence
IDGR

SEQ ID NO: 266 - protein, 6 aa, Unknown
  Description of Unknown: Thrombin cleavage site sequence
LVPRGS

SEQ ID NO: 267 - protein, 8 aa, Unknown
  Description of Unknown: PreScission cleavage site sequence
LEVLFQGP

SEQ ID NO: 268 - protein, 7 aa, Unknown
  Description of Unknown: TEV protease cleavage site sequence
EQLYFQG

SEQ ID NO: 269 - protein, 7 aa, Unknown
  Description of Unknown: 3C protease cleavage site sequence
ETLFQGP

SEQ ID NO: 270 - protein, 12 aa, Artificial Sequence
  Description of Artificial Sequence: Synthetic peptide
GESPGGSSGSES

SEQ ID NO: 271 - protein, 12 aa, Artificial Sequence
  Description of Artificial Sequence: Synthetic peptide
GSEGSSGPGESS

SEQ ID NO: 272 - protein, 12 aa, Artificial Sequence
  Description of Artificial Sequence: Synthetic peptide
GSSESGSSEGGP

SEQ ID NO: 273 - protein, 12 aa, Artificial Sequence
  Description of Artificial Sequence: Synthetic peptide
GSGGEPSESGSS

SEQ ID NO: 274 - DNA, 36 bp, Artificial Sequence
  Description of Artificial Sequence: Synthetic oligonucleotide
aggtgaatctccdggtggytcyagcggttcygartc

SEQ ID NO: 275 - DNA, 36 bp, Artificial Sequence
  Description of Artificial Sequence: Synthetic oligonucleotide
acctgaytcrgaaccgctrgarccacchggagattc

SEQ ID NO: 276 - DNA, 36 bp, Artificial Sequence
  Description of Artificial Sequence: Synthetic oligonucleotide
aggtagcgaaggttcttcyggtccdggygartcytc

SEQ ID NO: 277 - DNA, 36 bp, Artificial Sequence
  Description of Artificial Sequence: Synthetic oligonucleotide
acctgargaytcrcchggaccrgaagaaccttcgct

SEQ ID NO: 278 - DNA, 36 bp, Artificial Sequence
  Description of Artificial Sequence: Synthetic oligonucleotide
aggttcytcygaaagcggttcttcygarggyggtcc

SEQ ID NO: 279 - DNA, 36 bp, Artificial Sequence
  Description of Artificial Sequence: Synthetic oligonucleotide
acctggaccrccytcrgaagaaccgctttcrgarga

SEQ ID NO: 280 - DNA, 36 bp, Artificial Sequence
  Description of Artificial Sequence: Synthetic oligonucleotide
aggttcyggtggygaaccdtcygartctggtagctc

SEQ ID NO: 281 - DNA, 24 bp, Artificial Sequence
  Description of Artificial Sequence: Synthetic oligonucleotide
aggttcgtcttcactcgagggtac

SEQ ID NO: 282 - DNA, 16 bp, Artificial Sequence
  Description of Artificial Sequence: Synthetic oligonucleotide
cctcgagtgaagacga

SEQ ID NO: 283 - protein, 36 aa, Artificial Sequence
  Description of Artificial Sequence: Synthetic polypeptide
GSGGEPSESGSSGESPGGSSGSESGESPGGSSGSES

SEQ ID NO: 284 - protein, 36 aa, Artificial Sequence
  Description of Artificial Sequence: Synthetic polypeptide
GSEGSSGPGESSGESPGGSSGSESGSSESGSSEGGP

SEQ ID NO: 285 - protein, 36 aa, Artificial Sequence
  Description of Artificial Sequence: Synthetic polypeptide
GSSESGSSEGGPGSSESGSSEGGPGESPGGSSGSES

SEQ ID NO: 286 - protein, 36 aa, Artificial Sequence
  Description of Artificial Sequence: Synthetic polypeptide
GSGGEPSESGSSGSSESGSSEGGPGSGGEPSESGSS

SEQ ID NO: 287 - protein, 36 aa, Artificial Sequence
  Description of Artificial Sequence: Synthetic polypeptide
GSSESGSSEGGPGSEGSSGPGESSGSEGSSGPGESS

SEQ ID NO: 288 - protein, 36 aa, Artificial Sequence
  Description of Artificial Sequence: Synthetic polypeptide
GSSESGSSEGGPGESPGGSSGSESGSEGSSGPGESS

SEQ ID NO: 289 - protein, 36 aa, Artificial Sequence
  Description of Artificial Sequence: Synthetic polypeptide
GSGGEPSESGSSGSGGEPSESGSSGSEGSSGPGESS

SEQ ID NO: 290 - protein, 36 aa, Artificial Sequence
  Description of Artificial Sequence: Synthetic polypeptide
GSSESGSSEGGPGSEGSSGPGESSGESPGGSSGSES

SEQ ID NO: 291 - protein, 36 aa, Artificial Sequence
  Description of Artificial Sequence: Synthetic polypeptide
GSSESGSSEGGPGSSESGSSEGGPGSSESGSSEGGP

SEQ ID NO: 292 - protein, 36 aa, Artificial Sequence
  Description of Artificial Sequence: Synthetic polypeptide
GSGGEPSESGSSGSEGSSGPGESSGSSESGSSEGGP

SEQ ID NO: 293 - protein, 36 aa, Artificial Sequence; identical to SEQ ID NO: 286
  Description of Artificial Sequence: Synthetic polypeptide

SEQ ID NO: 294 - protein, 36 aa, Artificial Sequence
  Description of Artificial Sequence: Synthetic polypeptide
GSGGEPSESGSSGSSESGSSEGGPGESPGGSSGSES

SEQ ID NO: 295 - protein, 36 aa, Artificial Sequence
  Description of Artificial Sequence: Synthetic polypeptide
GSGGEPSESGSSGESPGGSSGSESGSEGSSGPGESS

SEQ ID NO: 296 - protein, 36 aa, Artificial Sequence
  Description of Artificial Sequence: Synthetic polypeptide
GSGGEPSESGSSGESPGGSSGSESGSGGEPSESGSS

SEQ ID NO: 297 - protein, 36 aa, Artificial Sequence; identical to SEQ ID NO: 291
  Description of Artificial Sequence: Synthetic polypeptide

SEQ ID NO: 298 - protein, 36 aa, Artificial Sequence
  Description of Artificial Sequence: Synthetic polypeptide
GESPGGSSGSESGSEGSSGPGESSGSEGSSGPGESS

SEQ ID NO: 299 - protein, 36 aa, Artificial Sequence
  Description of Artificial Sequence: Synthetic polypeptide
GSGGEPSESGSSGSGGEPSESGSSGSSESGSSEGGP

SEQ ID NO: 300 - protein, 36 aa, Artificial Sequence
  Description of Artificial Sequence: Synthetic polypeptide
GSGGEPSESGSSGSGGEPSESGSSGSGGEPSESGSS

SEQ ID NO: 301 - protein, 36 aa, Artificial Sequence
  Description of Artificial Sequence: Synthetic polypeptide
GSGGEPSESGSSGSSESGSSEGGPGSEGSSGPGESS

SEQ ID NO: 302 - protein, 36 aa, Artificial Sequence
  Description of Artificial Sequence: Synthetic polypeptide
GSGGEPSESGSSGSEGSSGPGESSGSGGEPSESGSS

SEQ ID NO: 303 - protein, 36 aa, Artificial Sequence; identical to SEQ ID NO: 296
  Description of Artificial Sequence: Synthetic polypeptide

SEQ ID NO: 304 - protein, 36 aa, Artificial Sequence
  Description of Artificial Sequence: Synthetic polypeptide
GSSESGSSEGGPGSGGEPSESGSSGSSESGSSEGGP

SEQ ID NO: 305 - protein, 36 aa, Artificial Sequence
  Description of Artificial Sequence: Synthetic polypeptide
GSEGSSGPGESSGESPGGSSGSESGSEGSSGPGESS

SEQ ID NO: 306 - protein, 36 aa, Artificial Sequence; identical to SEQ ID NO: 291
  Description of Artificial Sequence: Synthetic polypeptide

SEQ ID NO: 307 - protein, 36 aa, Artificial Sequence; identical to SEQ ID NO: 283
  Description of Artificial Sequence: Synthetic polypeptide

SEQ ID NO: 308 - protein, 36 aa, Artificial Sequence
  Description of Artificial Sequence: Synthetic polypeptide
GSGGEPSESGSSGSEGSSGPGESSGESPGGSSGSES

SEQ ID NO: 309 - protein, 36 aa, Artificial Sequence
  Description of Artificial Sequence: Synthetic polypeptide
GESPGGSSGSESGESPGGSSGSESGESPGGSSGSES

SEQ ID NO: 310 - protein, 36 aa, Artificial Sequence
  Description of Artificial Sequence: Synthetic polypeptide
GSEGSSGPGESSGSEGSSGPGESSGSGGEPSESGSS

SEQ ID NO: 311 - protein, 36 aa, Artificial Sequence; identical to SEQ ID NO: 308
  Description of Artificial Sequence: Synthetic polypeptide

SEQ ID NO: 312 - protein, 36 aa, Artificial Sequence; identical to SEQ ID NO: 286
  Description of Artificial Sequence: Synthetic polypeptide

SEQ ID NO: 313 - protein, 36 aa, Artificial Sequence
  Description of Artificial Sequence: Synthetic polypeptide
GSSESGSSEGGPGSGGEPSESGSSGSEGSSGPGESS

SEQ ID NO: 314 - protein, 36 aa, Artificial Sequence
  Description of Artificial Sequence: Synthetic polypeptide
GSGGEPSESGSSGSEGSSGPGESSGSEGSSGPGESS

SEQ ID NO: 315 - protein, 36 aa, Artificial Sequence; identical to SEQ ID NO: 286
  Description of Artificial Sequence: Synthetic polypeptide

SEQ ID NO: 316 - protein, 36 aa, Artificial Sequence; identical to SEQ ID NO: 283
  Description of Artificial Sequence: Synthetic polypeptide

SEQ ID NO: 317 - protein, 36 aa, Artificial Sequence
  Description of Artificial Sequence: Synthetic polypeptide
GSGGEPSESGSSGSGGEPSESGSSGESPGGSSGSES

SEQ ID NO: 318 - protein, 36 aa, Artificial Sequence
  Description of Artificial Sequence: Synthetic polypeptide
GSEGSSGPGESSGSSESGSSEGGPGSEGSSGPGESS

SEQ ID NO: 319 - protein, 36 aa, Artificial Sequence
  Description of Artificial Sequence: Synthetic polypeptide
GSSESGSSEGGPGESPGGSSGSESGESPGGSSGSES

SEQ ID NO: 320 - protein, 36 aa, Artificial Sequence; identical to SEQ ID NO: 310
  Description of Artificial Sequence: Synthetic polypeptide

SEQ ID NO: 321 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 322 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 323 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 324 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 325 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 326 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 327 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 328 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 329 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 330 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 331 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 332 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 333 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 334 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 335 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 336 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 337 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 338 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 339 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 340 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 341 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 342 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 343 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 344 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 345 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 346 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 347 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 348 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 349 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 350 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 351 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 352 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 353 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 354 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 355 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 356 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 357 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 358 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 359 - protein, 12 aa, Artificial Sequence
  Description of Artificial Sequence: Synthetic peptide
GSPAGSPTSTEE

SEQ ID NO: 360 - protein, 12 aa, Artificial Sequence
  Description of Artificial Sequence: Synthetic peptide
GSEPATSGSETP

SEQ ID NO: 361 - protein, 12 aa, Artificial Sequence
  Description of Artificial Sequence: Synthetic peptide
GTSESATPESGP

SEQ ID NO: 362 - protein, 12 aa, Artificial Sequence
  Description of Artificial Sequence: Synthetic peptide
GTSTEPSEGSAP

SEQ ID NO: 363 - DNA, 36 bp, Artificial Sequence
  Description of Artificial Sequence: Synthetic oligonucleotide
aggtagcccdgcwggytctccdacytcyacygarga

SEQ ID NO: 364 - DNA, 36 bp, Artificial Sequence
  Description of Artificial Sequence: Synthetic oligonucleotide
accttcytcrgtrgargthggagarccwgchgggct

SEQ ID NO: 365 - DNA, 36 bp, Artificial Sequence
  Description of Artificial Sequence: Synthetic oligonucleotide
aggtagcgaacckgcwacytcyggytctgaracycc

SEQ ID NO: 366 - DNA, 36 bp, Artificial Sequence
  Description of Artificial Sequence: Synthetic oligonucleotide
acctggrgtytcagarccrgargtwgcmggttcgct

SEQ ID NO: 367 - DNA, 36 bp, Artificial Sequence
  Description of Artificial Sequence: Synthetic oligonucleotide
aggtacytctgaaagcgcwacycckgartcyggycc

SEQ ID NO: 368 - DNA, 36 bp, Artificial Sequence
  Description of Artificial Sequence: Synthetic oligonucleotide
acctggrccrgaytcmggrgtwgcgctttcagargt

SEQ ID NO: 369 - DNA, 36 bp, Artificial Sequence
  Description of Artificial Sequence: Synthetic oligonucleotide
aggtacytctacygaaccktcygarggyagcgcwcc

SEQ ID NO: 370 - DNA, 36 bp, Artificial Sequence
  Description of Artificial Sequence: Synthetic oligonucleotide
acctggwgcgctrccytcrgamggttcrgtagargt

SEQ ID NO: 371 - DNA, 24 bp, Artificial Sequence
  Description of Artificial Sequence: Synthetic oligonucleotide
aggttcgtcttcactcgagggtac

SEQ ID NO: 372 - DNA, 16 bp, Artificial Sequence
  Description of Artificial Sequence: Synthetic oligonucleotide
cctcgagtgaagacga

SEQ ID NO: 373 - protein, 36 aa, Artificial Sequence
  Description of Artificial Sequence: Synthetic polypeptide
GSPAGSPTSTEEGTSESATPESGPGTSTEPSEGSAP

SEQ ID NO: 374 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 375 - protein, 36 aa, Artificial Sequence
  Description of Artificial Sequence: Synthetic polypeptide
GTSTEPSEGSAPGTSESATPESGPGTSESATPESGP

SEQ ID NO: 376 - protein, 36 aa, Artificial Sequence; identical to SEQ ID NO: 375
  Description of Artificial Sequence: Synthetic polypeptide

SEQ ID NO: 377 - protein, 36 aa, Artificial Sequence
  Description of Artificial Sequence: Synthetic polypeptide
GSEPATSGSETPGTSESATPESGPGSPAGSPTSTEE

SEQ ID NO: 378 - protein, 36 aa, Artificial Sequence
  Description of Artificial Sequence: Synthetic polypeptide
GTSESATPESGPGSEPATSGSETPGTSTEPSEGSAP

SEQ ID NO: 379 - protein, 36 aa, Artificial Sequence
  Description of Artificial Sequence: Synthetic polypeptide
GSPAGSPTSTEEGSPAGSPTSTEEGSEPATSGSETP

SEQ ID NO: 380 - protein, 36 aa, Artificial Sequence; identical to SEQ ID NO: 373
  Description of Artificial Sequence: Synthetic polypeptide

SEQ ID NO: 381 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 382 - protein, 36 aa, Artificial Sequence
  Description of Artificial Sequence: Synthetic polypeptide
GTSESATPESGPGTSTEPSEGSAPGTSTEPSEGSAP

SEQ ID NO: 383 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 384 - protein, 36 aa, Artificial Sequence
  Description of Artificial Sequence: Synthetic polypeptide
GSEPATSGSETPGSPAGSPTSTEEGTSESATPESGP

SEQ ID NO: 385 - protein, 36 aa, Artificial Sequence; identical to SEQ ID NO: 375
  Description of Artificial Sequence: Synthetic polypeptide

SEQ ID NO: 386 - protein, 36 aa, Artificial Sequence
  Description of Artificial Sequence: Synthetic polypeptide
GTSTEPSEGSAPGSEPATSGSETPGSPAGSPTSTEE

SEQ ID NO: 387 - protein, 36 aa, Artificial Sequence
  Description of Artificial Sequence: Synthetic polypeptide
GSPAGSPTSTEEGTSESATPESGPGSEPATSGSETP

SEQ ID NO: 388 - protein, 36 aa, Artificial Sequence
  Description of Artificial Sequence: Synthetic polypeptide
GTSESATPESGPGSPAGSPTSTEEGSPAGSPTSTEE

SEQ ID NO: 389 - protein, 36 aa, Artificial Sequence
  Description of Artificial Sequence: Synthetic polypeptide
GTSTEPSEGSAPGTSESATPESGPGTSTEPSEGSAP

SEQ ID NO: 390 - protein, 36 aa, Artificial Sequence
  Description of Artificial Sequence: Synthetic polypeptide
GSPAGSPTSTEEGTSTEPSEGSAPGSEPATSGSETP

SEQ ID NO: 391 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 392 - protein, 36 aa, Artificial Sequence; identical to SEQ ID NO: 377
  Description of Artificial Sequence: Synthetic polypeptide

SEQ ID NO: 393 - protein, 36 aa, Artificial Sequence; identical to SEQ ID NO: 382
  Description of Artificial Sequence: Synthetic polypeptide

SEQ ID NO: 394 - protein, 36 aa, Artificial Sequence; identical to SEQ ID NO: 391
  Description of Artificial Sequence: Synthetic polypeptide

SEQ ID NO: 395 - protein, 36 aa, Artificial Sequence; identical to SEQ ID NO: 374
  Description of Artificial Sequence: Synthetic polypeptide

SEQ ID NO: 396 - protein, 36 aa, Artificial Sequence
  Description of Artificial Sequence: Synthetic polypeptide
GSEPATSGSETPGTSESATPESGPGTSTEPSEGSAP

SEQ ID NO: 397 - protein, 36 aa, Artificial Sequence; identical to SEQ ID NO: 383
  Description of Artificial Sequence: Synthetic polypeptide

SEQ ID NO: 398 - protein, 36 aa, Artificial Sequence
  Description of Artificial Sequence: Synthetic polypeptide
GSEPATSGSETPGTSESATPESGPGSEPATSGSETP

SEQ ID NO: 399 - protein, 36 aa, Artificial Sequence; identical to SEQ ID NO: 398
  Description of Artificial Sequence: Synthetic polypeptide

SEQ ID NO: 400 - protein, 36 aa, Artificial Sequence
  Description of Artificial Sequence: Synthetic polypeptide
GSEPATSGSETPGSEPATSGSETPGTSTEPSEGSAP

SEQ ID NO: 401 - protein, 36 aa, Artificial Sequence
  Description of Artificial Sequence: Synthetic polypeptide
GTSESATPESGPGSEPATSGSETPGSEPATSGSETP

SEQ ID NO: 402 - protein, 36 aa, Artificial Sequence
  Description of Artificial Sequence: Synthetic polypeptide
GTSTEPSEGSAPGTSTEPSEGSAPGTSESATPESGP

SEQ ID NO: 403 - protein, 36 aa, Artificial Sequence
  Description of Artificial Sequence: Synthetic polypeptide
GSEPATSGSETPGTSESATPESGPGTSESATPESGP

SEQ ID NO: 404 - protein, 36 aa, Artificial Sequence; identical to SEQ ID NO: 400
  Description of Artificial Sequence: Synthetic polypeptide

SEQ ID NO: 405 - protein, 36 aa, Artificial Sequence
  Description of Artificial Sequence: Synthetic polypeptide
GSEPATSGSETPGTSTEPSEGSAPGSEPATSGSETP

SEQ ID NO: 406 - protein, 36 aa, Artificial Sequence
  Description of Artificial Sequence: Synthetic polypeptide
GTSTEPSEGSAPGTSTEPSEGSAPGSEPATSGSETP

SEQ ID NO: 407 - protein, 36 aa, Artificial Sequence; identical to SEQ ID NO: 386
  Description of Artificial Sequence: Synthetic polypeptide

SEQ ID NO: 408 - protein, 36 aa, Artificial Sequence; identical to SEQ ID NO: 384
  Description of Artificial Sequence: Synthetic polypeptide

SEQ ID NO: 409 - protein, 36 aa, Artificial Sequence
  Description of Artificial Sequence: Synthetic polypeptide
GTSESATPESGPGSEPATSGSETPGTSESATPESGP

SEQ ID NO: 410 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 411 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 412 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 413 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 414 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 415 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 416 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 417 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 418 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 419 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 420 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 421 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 422 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 423 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 424 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 425 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 426 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 427 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 428 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 429 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 430 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 431 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 432 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 433 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 434 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 435 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 436 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 437 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 438 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 439 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 440 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 441 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 442 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 443 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 444 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 445 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 446 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 447 - protein, 12 aa, Artificial Sequence
  Description of Artificial Sequence: Synthetic peptide
GSTSESPSGTAP

SEQ ID NO: 448 - protein, 12 aa, Artificial Sequence
  Description of Artificial Sequence: Synthetic peptide
GTSTPESGSASP

SEQ ID NO: 449 - protein, 12 aa, Artificial Sequence
  Description of Artificial Sequence: Synthetic peptide
GTSPSGESSTAP

SEQ ID NO: 450 - protein, 12 aa, Artificial Sequence
  Description of Artificial Sequence: Synthetic peptide
GSTSSTAESPGP

SEQ ID NO: 451 - DNA, 36 bp, Artificial Sequence
  Description of Artificial Sequence: Synthetic oligonucleotide
aggttctacyagcgaatcyccktctggyacygcwcc

SEQ ID NO: 452 - DNA, 36 bp, Artificial Sequence
  Description of Artificial Sequence: Synthetic oligonucleotide
acctggwgcrgtrccagamggrgattcgctrgtaga

SEQ ID NO: 453 - DNA, 36 bp, Artificial Sequence
  Description of Artificial Sequence: Synthetic oligonucleotide
aggtacytctacycckgaaagcggytcygcwtctcc

SEQ ID NO: 454 - DNA, 36 bp, Artificial Sequence
  Description of Artificial Sequence: Synthetic oligonucleotide
acctggagawgcrgarccgctttcmggrgtagargt

SEQ ID NO: 455 - DNA, 36 bp, Artificial Sequence
  Description of Artificial Sequence: Synthetic oligonucleotide
aggtacytcycckagcggygaatcttctacygcwcc

SEQ ID NO: 456 - DNA, 36 bp, Artificial Sequence
  Description of Artificial Sequence: Synthetic oligonucleotide
acctggwgcrgtagaagattcrccgctmggrgargt

SEQ ID NO: 457 - DNA, 36 bp, Artificial Sequence
  Description of Artificial Sequence: Synthetic oligonucleotide
aggttcyacyagctctacygcwgaatctcckggycc

SEQ ID NO: 458 - DNA, 36 bp, Artificial Sequence
  Description of Artificial Sequence: Synthetic oligonucleotide
acctggrccmggagattcwgcrgtagagctrgtrga

SEQ ID NO: 459 - DNA, 24 bp, Artificial Sequence
  Description of Artificial Sequence: Synthetic oligonucleotide
aggttcgtcttcactcgagggtac

SEQ ID NO: 460 - DNA, 16 bp, Artificial Sequence
  Description of Artificial Sequence: Synthetic oligonucleotide
cctcgagtgaagacga

SEQ ID NO: 461 - protein, 36 aa, Artificial Sequence
  Description of Artificial Sequence: Synthetic polypeptide
GTSTPESGSASPGTSPSGESSTAPGTSPSGESSTAP

SEQ ID NO: 462 - protein, 36 aa, Artificial Sequence
  Description of Artificial Sequence: Synthetic polypeptide
GTSPSGESSTAPGSTSSTAESPGPGTSPSGESSTAP

SEQ ID NO: 463 - protein, 36 aa, Artificial Sequence
  Description of Artificial Sequence: Synthetic polypeptide
GSTSSTAESPGPGTSPSGESSTAPGTSTPESGSASP

SEQ ID NO: 464 - protein, 36 aa, Artificial Sequence
  Description of Artificial Sequence: Synthetic polypeptide
GSTSSTAESPGPGSTSSTAESPGPGTSPSGESSTAP

SEQ ID NO: 465 - protein, 36 aa, Artificial Sequence; identical to SEQ ID NO: 463
  Description of Artificial Sequence: Synthetic polypeptide

SEQ ID NO: 466 - protein, 36 aa, Artificial Sequence
  Description of Artificial Sequence: Synthetic polypeptide
GSTSSTAESPGPGTSTPESGSASPGSTSESPSGTAP

SEQ ID NO: 467 - protein, 36 aa, Artificial Sequence
  Description of Artificial Sequence: Synthetic polypeptide
GSTSSTAESPGPGTSTPESGSASPGTSTPESGSASP

SEQ ID NO: 468 - protein, 36 aa, Artificial Sequence
  Description of Artificial Sequence: Synthetic polypeptide
GSTSESPSGTAPGTSPSGESSTAPGSTSESPSGTAP

SEQ ID NO: 469 - protein, 36 aa, Artificial Sequence; identical to SEQ ID NO: 464
  Description of Artificial Sequence: Synthetic polypeptide

SEQ ID NO: 470 - protein, 36 aa, Artificial Sequence; identical to SEQ ID NO: 466
  Description of Artificial Sequence: Synthetic polypeptide

SEQ ID NO: 471 - protein, 36 aa, Artificial Sequence; identical to SEQ ID NO: 464
  Description of Artificial Sequence: Synthetic polypeptide

SEQ ID NO: 472 - protein, 36 aa, Artificial Sequence
  Description of Artificial Sequence: Synthetic polypeptide
GSTSSTAESPGPGSTSESPSGTAPGSTSSTAESPGP

SEQ ID NO: 473 - protein, 36 aa, Artificial Sequence
  Description of Artificial Sequence: Synthetic polypeptide
GSTSSTAESPGPGSTSSTAESPGPGSTSSTAESPGP

SEQ ID NO: 474 - protein, 36 aa, Artificial Sequence
  Description of Artificial Sequence: Synthetic polypeptide
GSTSESPSGTAPGSTSSTAESPGPGSTSSTAESPGP

SEQ ID NO: 475 - protein, 36 aa, Artificial Sequence
  Description of Artificial Sequence: Synthetic polypeptide
GSTSESPSGTAPGSTSESPSGTAPGSTSESPSGTAP

SEQ ID NO: 476 - protein, 36 aa, Artificial Sequence; identical to SEQ ID NO: 473
  Description of Artificial Sequence: Synthetic polypeptide

SEQ ID NO: 477 - protein, 36 aa, Artificial Sequence; identical to SEQ ID NO: 464
  Description of Artificial Sequence: Synthetic polypeptide

SEQ ID NO: 478 - protein, 36 aa, Artificial Sequence
  Description of Artificial Sequence: Synthetic polypeptide
GSSPSASTGTGPGSSTPSGATGSPGSSTPSGATGSP

SEQ ID NO: 479 - protein, 36 aa, Artificial Sequence
  Description of Artificial Sequence: Synthetic polypeptide
GTSPSGESSTAPGTSTPESGSASPGSTSSTAESPGP

SEQ ID NO: 480 - protein, 36 aa, Artificial Sequence
  Description of Artificial Sequence: Synthetic polypeptide
GSTSSTAESPGPGSTSSTAESPGPGTSTPESGSASP

SEQ ID NO: 481 - protein, 36 aa, Artificial Sequence
  Description of Artificial Sequence: Synthetic polypeptide
GTSPSGESSTAPGSTSSTAESPGPGTSTPESGSASP

SEQ ID NO: 482 - protein, 36 aa, Artificial Sequence; identical to SEQ ID NO: 474
  Description of Artificial Sequence: Synthetic polypeptide

SEQ ID NO: 483 - protein, 36 aa, Artificial Sequence; identical to SEQ ID NO: 472
  Description of Artificial Sequence: Synthetic polypeptide

SEQ ID NO: 484 - protein, 36 aa, Artificial Sequence; identical to SEQ ID NO: 463
  Description of Artificial Sequence: Synthetic polypeptide

SEQ ID NO: 485 - protein, 36 aa, Artificial Sequence
  Description of Artificial Sequence: Synthetic polypeptide
GSTSESPSGTAPGSTSESPSGTAPGTSPSGESSTAP

SEQ ID NO: 486 - protein, 36 aa, Artificial Sequence
  Description of Artificial Sequence: Synthetic polypeptide
GSTSESPSGTAPGSTSESPSGTAPGTSTPESGSASP

SEQ ID NO: 487 - protein, 36 aa, Artificial Sequence
  Description of Artificial Sequence: Synthetic polypeptide
GTSTPESGSASPGSTSSTAESPGPGSTSSTAESPGP

SEQ ID NO: 488 - protein, 36 aa, Artificial Sequence; identical to SEQ ID NO: 485
  Description of Artificial Sequence: Synthetic polypeptide

SEQ ID NO: 489 - protein, 36 aa, Artificial Sequence
  Description of Artificial Sequence: Synthetic polypeptide
GSTSSTAESPGPGSTSSTAESPGPGSTSESPSGTAP

SEQ ID NO: 490 - protein, 36 aa, Artificial Sequence; identical to SEQ ID NO: 480
  Description of Artificial Sequence: Synthetic polypeptide

SEQ ID NO: 491 - protein, 36 aa, Artificial Sequence; identical to SEQ ID NO: 489
  Description of Artificial Sequence: Synthetic polypeptide

SEQ ID NO: 492 - protein, 36 aa, Artificial Sequence
  Description of Artificial Sequence: Synthetic polypeptide
GTSPSGESSTAPGSTSESPSGTAPGSTSSTAESPGP

SEQ ID NO: 493 - protein, 36 aa, Artificial Sequence
  Description of Artificial Sequence: Synthetic polypeptide
GSTSESPSGTAPGTSPSGESSTAPGSTSSTAESPGP

SEQ ID NO: 494 - protein, 36 aa, Artificial Sequence
  Description of Artificial Sequence: Synthetic polypeptide
GSTSSTAESPGPGSTSESPSGTAPGTSPSGESSTAP

SEQ ID NO: 495 - protein, 36 aa, Artificial Sequence; identical to SEQ ID NO: 486
  Description of Artificial Sequence: Synthetic polypeptide

SEQ ID NO: 496 - protein, 36 aa, Artificial Sequence
  Description of Artificial Sequence: Synthetic polypeptide
GTSTPESGSASPGSTSESPSGTAPGSTSSTAESPGP

SEQ ID NO: 497 - protein, 36 aa, Artificial Sequence
  Description of Artificial Sequence: Synthetic polypeptide
GSTSSTAESPGPGTSPSGESSTAPGTSPSGESSTAP

SEQ ID NO: 498 - protein, 36 aa, Artificial Sequence
  Description of Artificial Sequence: Synthetic polypeptide
GTSPSGESSTAPGTSPSGESSTAPGTSPSGESSTAP

SEQ ID NO: 499 - protein, 36 aa, Artificial Sequence; identical to SEQ ID NO: 466
  Description of Artificial Sequence: Synthetic polypeptide

SEQ ID NO: 500 - protein, 36 aa, Artificial Sequence
  Description of Artificial Sequence: Synthetic polypeptide
GSTSESPSGTAPGTSPSGESSTAPGTSPSGESSTAP

SEQ ID NO: 501 - protein, 36 aa, Artificial Sequence
  Description of Artificial Sequence: Synthetic polypeptide
GSTSESPSGTAPGTSTPESGSASPGSTSSTAESPGP

SEQ ID NO: 502 - protein, 36 aa, Artificial Sequence; identical to SEQ ID NO: 489
  Description of Artificial Sequence: Synthetic polypeptide

SEQ ID NO: 503 - protein, 36 aa, Artificial Sequence
  Description of Artificial Sequence: Synthetic polypeptide
GSTSESPSGTAPGTSTPESGSASPGTSTPESGSASP

SEQ ID NO: 504 - protein, 36 aa, Artificial Sequence; identical to SEQ ID NO: 503
  Description of Artificial Sequence: Synthetic polypeptide

SEQ ID NO: 505 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 506 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 507 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 508 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 509 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 510 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 511 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 512 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 513 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 514 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 515 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 516 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 517 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 518 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 519 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 520 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 521 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 522 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 523 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 524 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 525 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 526 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 527 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 528 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 529 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 530 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 531 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 532 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 533 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 534 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 535 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 536 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 537 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 538 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 539 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 540 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 541 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 542 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 543 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 544 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 545 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 546 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 547 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 548 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 549 - protein, 12 aa, Artificial Sequence
  Description of Artificial Sequence: Synthetic peptide
GTPGSGTASSSP

SEQ ID NO: 550 - protein, 12 aa, Artificial Sequence
  Description of Artificial Sequence: Synthetic peptide
GSSTPSGATGSP

SEQ ID NO: 551 - protein, 12 aa, Artificial Sequence
  Description of Artificial Sequence: Synthetic peptide
GSSPSASTGTGP

SEQ ID NO: 552 - protein, 12 aa, Artificial Sequence
  Description of Artificial Sequence: Synthetic peptide
GASPGTSSTGSP

SEQ ID NO: 553 - DNA, 36 bp, Artificial Sequence
  Description of Artificial Sequence: Synthetic oligonucleotide
aggtacycckggyagcggtacygcwtcttcytctcc

SEQ ID NO: 554 - DNA, 36 bp, Artificial Sequence
  Description of Artificial Sequence: Synthetic oligonucleotide
acctggagargaagawgcrgtaccgctrccmggrgt

SEQ ID NO: 555 - DNA, 36 bp, Artificial Sequence
  Description of Artificial Sequence: Synthetic oligonucleotide
aggtagctctacyccktctggtgcwacyggytcycc

SEQ ID NO: 556 - DNA, 36 bp, Artificial Sequence
  Description of Artificial Sequence: Synthetic oligonucleotide
acctggrgarccrgtwgcaccagamggrgtagagct

SEQ ID NO: 557 - DNA, 36 bp, Artificial Sequence
  Description of Artificial Sequence: Synthetic oligonucleotide
aggttctagcccktctgcwtcyacyggtacyggycc

SEQ ID NO: 558 - DNA, 36 bp, Artificial Sequence
  Description of Artificial Sequence: Synthetic oligonucleotide
acctggrccrgtaccrgtrgawgcagamgggctaga

SEQ ID NO: 559 - DNA, 36 bp, Artificial Sequence
  Description of Artificial Sequence: Synthetic oligonucleotide
aggtgcwtcycckggyacyagctctacyggttctcc

SEQ ID NO: 560 - DNA, 36 bp, Artificial Sequence
  Description of Artificial Sequence: Synthetic oligonucleotide
acctggagaaccrgtagagctrgtrccmggrgawgc

SEQ ID NO: 561 - DNA, 24 bp, Artificial Sequence
  Description of Artificial Sequence: Synthetic oligonucleotide
aggttcgtcttcactcgagggtac

SEQ ID NO: 562 - DNA, 16 bp, Artificial Sequence
  Description of Artificial Sequence: Synthetic oligonucleotide
cctcgagtgaagacga

SEQ ID NO: 563 - protein, 36 aa, Artificial Sequence
  Description of Artificial Sequence: Synthetic polypeptide
GASPGTSSTGSPGTPGSGTASSSPGSSTPSGATGSP

SEQ ID NO: 564 - protein, 36 aa, Artificial Sequence
  Description of Artificial Sequence: Synthetic polypeptide
GSSTPSGATGSPGSSPSASTGTGPGSSTPSGATGSP

SEQ ID NO: 565 - protein, 36 aa, Artificial Sequence
  Description of Artificial Sequence: Synthetic polypeptide
GASPGTSSTGSPGSSPSASTGTGPGSSTPSGATGSP

SEQ ID NO: 566 - protein, 36 aa, Artificial Sequence
  Description of Artificial Sequence: Synthetic polypeptide
GTPGSGTASSSPGSSTPSGATGSPGASPGTSSTGSP

SEQ ID NO: 567 - protein, 36 aa, Artificial Sequence
  Description of Artificial Sequence: Synthetic polypeptide
GTPGSGTASSSPGASPGTSSTGSPGSRPSASTGTGP

SEQ ID NO: 568 - protein, 36 aa, Artificial Sequence
  Description of Artificial Sequence: Synthetic polypeptide
GASPGTSSTGSPGSSTPSGATGSPGASPGTSSTGSP

SEQ ID NO: 569 - protein, 36 aa, Artificial Sequence
  Description of Artificial Sequence: Synthetic polypeptide
GTPGSGTASSSPGSSTPSGATGSPGSSTPSGATGSP

SEQ ID NO: 570 - protein, 36 aa, Artificial Sequence
  Description of Artificial Sequence: Synthetic polypeptide
GASPGTSSTGSPGASPGTSSTGSPGASPGTSSTGSP

SEQ ID NO: 571 - protein, 36 aa, Artificial Sequence
  Description of Artificial Sequence: Synthetic polypeptide
GSSTPSGATGSPGSSPSASTGTGPGASPGTSSTGSP

SEQ ID NO: 572 - protein, 36 aa, Artificial Sequence
  Description of Artificial Sequence: Synthetic polypeptide
GSSTPSGATGSPGSSTPSGATGSPGTPGSGTASSSP

SEQ ID NO: 573 - protein, 36 aa, Artificial Sequence
  Description of Artificial Sequence: Synthetic polypeptide
GSSTPSGATGSPGSSTPSGATGSPGASPGTSSTGSP

SEQ ID NO: 574 - protein, 36 aa, Artificial Sequence
  Description of Artificial Sequence: Synthetic polypeptide
GTPGSGTASSSPGSSPSASTGTGPGSSTPSGATGSP

SEQ ID NO: 575 - protein, 36 aa, Artificial Sequence
  Description of Artificial Sequence: Synthetic polypeptide
GASPGTSSTGSPGSSPSASTGTGPGTPGSGTASSSP

SEQ ID NO: 576 - protein, 36 aa, Artificial Sequence; identical to SEQ ID NO: 573
  Description of Artificial Sequence: Synthetic polypeptide

SEQ ID NO: 577 - protein, 36 aa, Artificial Sequence
  Description of Artificial Sequence: Synthetic polypeptide
GTPGSGTASSSPGSSTPSGATGSPGSSPSASTGTGP

SEQ ID NO: 578 - protein, 36 aa, Artificial Sequence
  Description of Artificial Sequence: Synthetic polypeptide
GSSTPSGATGSPGTPGSGTASSSPGTPGSGTASSSP

SEQ ID NO: 579 - protein, 36 aa, Artificial Sequence; identical to SEQ ID NO: 566
  Description of Artificial Sequence: Synthetic polypeptide

SEQ ID NO: 580 - protein, 36 aa, Artificial Sequence; identical to SEQ ID NO: 573
  Description of Artificial Sequence: Synthetic polypeptide

SEQ ID NO: 581 - protein, 36 aa, Artificial Sequence; identical to SEQ ID NO: 563
  Description of Artificial Sequence: Synthetic polypeptide

SEQ ID NO: 582 - protein, 36 aa, Artificial Sequence
  Description of Artificial Sequence: Synthetic polypeptide
GSSPSASTGTGPGSSTPSGATGSPGTPGSGTASSSP

SEQ ID NO: 583 - protein, 36 aa, Artificial Sequence; identical to SEQ ID NO: 565
  Description of Artificial Sequence: Synthetic polypeptide

SEQ ID NO: 584 - protein, 36 aa, Artificial Sequence
  Description of Artificial Sequence: Synthetic polypeptide
GASPGTSSTGSPGSSTPSGATGSPGSSTPSGATGSP

SEQ ID NO: 585 - protein, 36 aa, Artificial Sequence
  Description of Artificial Sequence: Synthetic polypeptide
GTPGSGTASSSPGSSTPSGATGSPGTPGSGTASSSP

SEQ ID NO: 586 - protein, 36 aa, Artificial Sequence; identical to SEQ ID NO: 478
  Description of Artificial Sequence: Synthetic polypeptide

SEQ ID NO: 587 - protein, 36 aa, Artificial Sequence
  Description of Artificial Sequence: Synthetic polypeptide
GASPGTSSTGSPGSSPSASTGTGPGSSPSASTGTGP

SEQ ID NO: 588 - protein, 36 aa, Artificial Sequence
  Description of Artificial Sequence: Synthetic polypeptide
GTPGSGTASSSPGASPGTSSTGSPGASPGTSSTGSP

SEQ ID NO: 589 - protein, 36 aa, Artificial Sequence
  Description of Artificial Sequence: Synthetic polypeptide
GSSTPSGATGSPGASPGTSSTGSPGSSTPSGATGSP

SEQ ID NO: 590 - protein, 36 aa, Artificial Sequence
  Description of Artificial Sequence: Synthetic polypeptide
GSSTPSGATGSPGTPGSGTASSSPGSSTPSGATGSP

SEQ ID NO: 591 - protein, 36 aa, Artificial Sequence; identical to SEQ ID NO: 565
  Description of Artificial Sequence: Synthetic polypeptide

SEQ ID NO: 592 - protein, 36 aa, Artificial Sequence
  Description of Artificial Sequence: Synthetic polypeptide
GSSTPSGATGSPGSSTPSGATGSPGSSTPSGATGSP

SEQ ID NO: 593 - protein, 36 aa, Artificial Sequence
  Description of Artificial Sequence: Synthetic polypeptide
GASPGTSSTGSPGTPGSGTASSSPGASPGTSSTGSP

SEQ ID NO: 594 - protein, 36 aa, Artificial Sequence; identical to SEQ ID NO: 571
  Description of Artificial Sequence: Synthetic polypeptide

SEQ ID NO: 595 - protein, 36 aa, Artificial Sequence
  Description of Artificial Sequence: Synthetic polypeptide
GASPGTSSTGSPGSSTPSGATGSPGSSPSASTGTGP

SEQ ID NO: 596 - protein, 36 aa, Artificial Sequence; identical to SEQ ID NO: 566
  Description of Artificial Sequence: Synthetic polypeptide

SEQ ID NO: 597 - protein, 36 aa, Artificial Sequence; identical to SEQ ID NO: 590
  Description of Artificial Sequence: Synthetic polypeptide

SEQ ID NO: 598 - protein, 36 aa, Artificial Sequence
  Description of Artificial Sequence: Synthetic polypeptide
GSSPSASTGTGPGSSPSASTGTGPGASPGTSSTGSP

SEQ ID NO: 599 - protein, 36 aa, Artificial Sequence
  Description of Artificial Sequence: Synthetic polypeptide
GTPGSGTASSSPGSSTPSGATGSPGSNPSASTGTGP

SEQ ID NO: 600 - protein, 36 aa, Artificial Sequence
  Description of Artificial Sequence: Synthetic polypeptide
GSSPSASTGTGPGSSTPSGATGSPGASPGTSSTGSP

SEQ ID NO: 601 - protein, 36 aa, Artificial Sequence
  Description of Artificial Sequence: Synthetic polypeptide
GSSTPSGATGSPGASPGTSSTGSPGTPGSGTASSSP

SEQ ID NO: 602 - protein, 36 aa, Artificial Sequence; identical to SEQ ID NO: 592
  Description of Artificial Sequence: Synthetic polypeptide

SEQ ID NO: 603 - protein, 36 aa, Artificial Sequence; identical to SEQ ID NO: 563
  Description of Artificial Sequence: Synthetic polypeptide

SEQ ID NO: 604 - protein, 36 aa, Artificial Sequence
  Description of Artificial Sequence: Synthetic polypeptide
GSSTPSGATGSPGSSPSASTGTGPGSSPSASTGTGP

SEQ ID NO: 605 - protein, 36 aa, Artificial Sequence; identical to SEQ ID NO: 587
  Description of Artificial Sequence: Synthetic polypeptide

SEQ ID NO: 606 - protein, 36 aa, Artificial Sequence; identical to SEQ ID NO: 575
  Description of Artificial Sequence: Synthetic polypeptide

SEQ ID NO: 607 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 608 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 609 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 610 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 611 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 612 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 613 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 614 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 615 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 616 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 617 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 618 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 619 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 620 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 621 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 622 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 623 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 624 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 625 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 626 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 627 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 628 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 629 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 630 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 631 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 632 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 633 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 634 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 635 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 636 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 637 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 638 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 639 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 640 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 641 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 642 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 643 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 644 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 645 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 646 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 647 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 648 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 649 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 650 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 651 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 652 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 653 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 654 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 655 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 656 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 657 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 658 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 659 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 660 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 661 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 662 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 663 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 664 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 665 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 666 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 667 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 668 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 669 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 670 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 671 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 672 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 673 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 674 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 675 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 676 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 677 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 678 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 679 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 680 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 681 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 682 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 683 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 684 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 685 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 686 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 687 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 688 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 689 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 690 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 691 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 692 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 693 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 694 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 695 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 696 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 697 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 698 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 699 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 700 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 701 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 702 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 703 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 704 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 705 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 706 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 707 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 708 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 709 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 710 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 711 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 712 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 713 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 714 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 715 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 716 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 717 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 718 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 719 - protein, 11 aa, Artificial Sequence
  Description of Artificial Sequence: Synthetic peptide
GASASGAPSTG

SEQ ID NO: 720 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 721 - DNA, 49 bp, Artificial Sequence
  Description of Artificial Sequence: Synthetic oligonucleotide
cctcgagtgaagacgaacctccgcttggggccggccccgttggttctgg

SEQ ID NO: 722 - protein, 11 aa, Artificial Sequence
  Description of Artificial Sequence: Synthetic peptide
GPEPTGPAPSG

SEQ ID NO: 723 - protein, 13 aa, Artificial Sequence
  Description of Artificial Sequence: Synthetic peptide
MASPAGSPTSTEE

SEQ ID NO: 724 - protein, 13 aa, Artificial Sequence
  Description of Artificial Sequence: Synthetic peptide
MATSESATPESGP

SEQ ID NO: 725 - protein, 13 aa, Artificial Sequence
  Description of Artificial Sequence: Synthetic peptide
MATSPSGESSTAP

SEQ ID NO: 726 - protein, 13 aa, Artificial Sequence
  Description of Artificial Sequence: Synthetic peptide
MESTSSTAESPGP

SEQ ID NO: 727 - protein, 13 aa, Artificial Sequence
  Description of Artificial Sequence: Synthetic peptide
MASSTPSGATGSP

SEQ ID NO: 728 - protein, 13 aa, Artificial Sequence
  Description of Artificial Sequence: Synthetic peptide
MEASPGTSSTGSP

SEQ ID NO: 729 - protein, 11 aa, Artificial Sequence
  Description of Artificial Sequence: Synthetic peptide
MASTPESGSSG

SEQ ID NO: 730 - DNA, 51 bp, Artificial Sequence
  Description of Artificial Sequence: Synthetic oligonucleotide
atggctagtccggctggctctccgacctccactgaggaaggtacttctact

SEQ ID NO: 731 - DNA, 51 bp, Artificial Sequence
  Description of Artificial Sequence: Synthetic oligonucleotide
atggctagtcctgctggctctccaacctccactgaggaaggtacttctact

SEQ ID NO: 732 - DNA, 51 bp, Artificial Sequence
  Description of Artificial Sequence: Synthetic oligonucleotide
atggctagtccagcaggctctcctacctccaccgaggaaggtacttctact

SEQ ID NO: 733 - DNA, 51 bp, Artificial Sequence
  Description of Artificial Sequence: Synthetic oligonucleotide
atggctagtcctgctggctctccgacctctactgaggaaggtacttctact

SEQ ID NO: 734 - DNA, 51 bp, Artificial Sequence
  Description of Artificial Sequence: Synthetic oligonucleotide
atggctacatccgaaagcgcaacccctgagtccggtccaggtacttctact

SEQ ID NO: 735 - DNA, 51 bp, Artificial Sequence
  Description of Artificial Sequence: Synthetic oligonucleotide
atggctacatccgaaagcgcaacccctgaatctggtccaggtacttctact

SEQ ID NO: 736 - DNA, 51 bp, Artificial Sequence
  Description of Artificial Sequence: Synthetic oligonucleotide
atggctacgtctgaaagcgctactccggaatctggtccaggtacttctact

SEQ ID NO: 737 - DNA, 51 bp, Artificial Sequence
  Description of Artificial Sequence: Synthetic oligonucleotide
atggctacgtccgaaagcgctacccctgaatccggtccaggtacttctact

SEQ ID NO: 738 - DNA, 51 bp, Artificial Sequence
  Description of Artificial Sequence: Synthetic oligonucleotide
atggctagttctaccccgtctggtgcaaccggttccccaggtacttctact

SEQ ID NO: 739 - DNA, 51 bp, Artificial Sequence
  Description of Artificial Sequence: Synthetic oligonucleotide
atggctagctccactccgtctggtgctaccggttccccaggtacttctact

SEQ ID NO: 740 - DNA, 51 bp, Artificial Sequence
  Description of Artificial Sequence: Synthetic oligonucleotide
atggctagctctactccgtctggtgctactggttccccaggtacttctact

SEQ ID NO: 741 - DNA, 51 bp, Artificial Sequence
  Description of Artificial Sequence: Synthetic oligonucleotide
atggctagttctaccccttctggtgctactggttctccaggtacttctact

SEQ ID NO: 742 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 743 - DNA, 180 bp, Artificial Sequence; identical to SEQ ID NO: 742
  Description of Artificial Sequence: Synthetic polynucleotide

SEQ ID NO: 744 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 745 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 746 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 747 - DNA, 180 bp, Artificial Sequence; identical to SEQ ID NO: 745
  Description of Artificial Sequence: Synthetic polynucleotide

SEQ ID NO: 748 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 749 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 750 - DNA, 180 bp, Artificial Sequence; identical to SEQ ID NO: 748
  Description of Artificial Sequence: Synthetic polynucleotide

SEQ ID NO: 751 - DNA, 180 bp, Artificial Sequence; identical to SEQ ID NO: 749
  Description of Artificial Sequence: Synthetic polynucleotide

SEQ ID NO: 752 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 753 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 754 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 755 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 756 - DNA, 37 bp, Artificial Sequence
  Description of Artificial Sequence: Synthetic primer
ataaagggtctccaggtcgtccgtccggtcgtaaatc

SEQ ID NO: 757 - DNA, 36 bp, Artificial Sequence
  Description of Artificial Sequence: Synthetic primer
aactcgaagcttttattcgtcctcctggaagtaaaa

SEQ ID NO: 758 - protein, 12 aa, Artificial Sequence
  Description of Artificial Sequence: Synthetic peptide
GSTSESPSGTAP

SEQ ID NO: 759 - protein, 12 aa, Artificial Sequence
  Description of Artificial Sequence: Synthetic peptide
GTSTPESGSASP

SEQ ID NO: 760 - protein, 12 aa, Artificial Sequence
  Description of Artificial Sequence: Synthetic peptide
GTSPSGESSTAP

SEQ ID NO: 761 - protein, 12 aa, Artificial Sequence
  Description of Artificial Sequence: Synthetic peptide
GSTSSTAESPGP

SEQ ID NO: 762 - protein, 24 aa, Artificial Sequence
  Description of Artificial Sequence: Synthetic peptide
GSPAGSPTSTEEGTSESATPESGP

SEQ ID NO: 763 - protein, 36 aa, Artificial Sequence; identical to SEQ ID NO: 373
  Description of Artificial Sequence: Synthetic polypeptide

SEQ ID NO: 764 - protein, 48 aa, Artificial Sequence
  Description of Artificial Sequence: Synthetic polypeptide
GSPAGSPTSTEEGTSESATPESGPGTSTEPSEGSAPGSPAGSPTSTEE

SEQ ID NO: 765 - protein, 60 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAP

SEQ ID NO: 766 - protein, 108 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETP

SEQ ID NO: 767 - protein, 216 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAP

SEQ ID NO: 768 - protein, 432 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAP

SEQ ID NO: 769 - protein, 864 aa, Artificial Sequence; identical to SEQ ID NO: 213
  Description of Artificial Sequence: Synthetic polypeptide

SEQ ID NO: 770 - protein, 576 aa, Artificial Sequence; identical to SEQ ID NO: 209
  Description of Artificial Sequence: Synthetic polypeptide

SEQ ID NO: 771 - protein, 576 aa, Artificial Sequence; identical to SEQ ID NO: 210
  Description of Artificial Sequence: Synthetic polypeptide

SEQ ID NO: 772 - protein, 540 aa, Artificial Sequence; identical to SEQ ID NO: 208
  Description of Artificial Sequence: Synthetic polypeptide

SEQ ID NO: 773 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 774 - protein, 864 aa, Artificial Sequence; identical to SEQ ID NO: 213
  Description of Artificial Sequence: Synthetic polypeptide

SEQ ID NO: 775 - protein, 875 aa, Artificial Sequence; identical to SEQ ID NO: 214
  Description of Artificial Sequence: Synthetic polypeptide
  MOD_RES (430)..(432): Any amino acid
  MOD_RES (443)..(446): Any amino acid

SEQ ID NO: 776 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 777 - protein, 875 aa, Artificial Sequence; identical to SEQ ID NO: 216
  Description of Artificial Sequence: Synthetic polypeptide

SEQ ID NO: 778 - protein, 1318 aa, Artificial Sequence; identical to SEQ ID NO: 219
  Description of Artificial Sequence: Synthetic polypeptide

SEQ ID NO: 779 - protein, 924 aa, Artificial Sequence; identical to SEQ ID NO: 218
  Description of Artificial Sequence: Synthetic polypeptide

SEQ ID NO: 780 - protein, 913 aa, Artificial Sequence; identical to SEQ ID NO: 217
  Description of Artificial Sequence: Synthetic polypeptide

SEQ ID NO: 781 - protein, 84 aa, Artificial Sequence
  Description of Artificial Sequence: Synthetic polypeptide
ASPAAPAPASPAAPAPSAPAAAPASPAPAAPSAPAPAAPSAASPAAPSAPPAAASPAAPSAPPAASAAAPAAASAAASAPSAAA

SEQ ID NO: 782 - protein, 4 aa, Artificial Sequence
  Description of Artificial Sequence: Synthetic peptide
GGSG

SEQ ID NO: 783 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 784 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 785 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 786 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 787 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 788 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 789 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 790 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 791 - protein, 576 aa, Artificial Sequence; identical to SEQ ID NO: 209
  Description of Artificial Sequence: Synthetic polypeptide

SEQ ID NO: 792 - protein, 576 aa, Artificial Sequence; identical to SEQ ID NO: 210
  Description of Artificial Sequence: Synthetic polypeptide

SEQ ID NO: 793 - protein, 540 aa, Artificial Sequence; identical to SEQ ID NO: 208
  Description of Artificial Sequence: Synthetic polypeptide

SEQ ID NO: 794 - protein, 504 aa, Artificial Sequence; identical to SEQ ID NO: 773
  Description of Artificial Sequence: Synthetic polypeptide

SEQ ID NO: 795 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 796 - protein, 875 aa, Artificial Sequence; identical to SEQ ID NO: 214
  Description of Artificial Sequence: Synthetic polypeptide
  MOD_RES (430)..(432): Any amino acid
  MOD_RES (443)..(446): Any amino acid

SEQ ID NO: 797 - protein, 864 aa, Artificial Sequence; identical to SEQ ID NO: 776
  Description of Artificial Sequence: Synthetic polypeptide

SEQ ID NO: 798 - protein, 875 aa, Artificial Sequence; identical to SEQ ID NO: 216
  Description of Artificial Sequence: Synthetic polypeptide

SEQ ID NO: 799 - protein, 1318 aa, Artificial Sequence; identical to SEQ ID NO: 219
  Description of Artificial Sequence: Synthetic polypeptide

SEQ ID NO: 800 - protein, 9 aa, Artificial Sequence
  Description of Artificial Sequence: Synthetic peptide
FDKLPRTSG

SEQ ID NO: 801 - protein, 7 aa, Artificial Sequence
  Description of Artificial Sequence: Synthetic peptide
FKLMVWY

SEQ ID NO: 802 - protein, 66 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGGSEGEGGSEGSE

SEQ ID NO: 803 - protein, 102 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGSGEGEGGSEGSEGEGGSEGSEGEGSEGGSEGEGGSEGSEGEGSEGGGE

SEQ ID NO: 804 - protein, 174 aa, Artificial Sequence
  Description of Artificial Sequence: Synthetic polypeptide
HSQGTFTSDYSKYLDSRRAQDFVQWLMNTGGEGGSEGSEGEGSEGSGEGEGGSEGSEGEGSEGSGEGEGGSEGSEGEGGSEGSEGEGGEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 805 - protein, 318 aa, Artificial Sequence
  Description of Artificial Sequence: Synthetic polypeptide
HSQGTFTSDYSKYLDSRRAQDFVQWLMNTGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 806 - protein, 174 aa, Artificial Sequence
  Description of Artificial Sequence: Synthetic polypeptide
HSQGTFTSDYSKYLDSRRAQDFVQWLMNTGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 807 - protein, 174 aa, Artificial Sequence
  Description of Artificial Sequence: Synthetic polypeptide
HSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 808 - protein, 318 aa, Artificial Sequence
  Description of Artificial Sequence: Synthetic polypeptide
HSQGTFTSDYSKYLDSRRAQDFVQWLMNTGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 809 - protein, 534 aa, Artificial Sequence
  Description of Artificial Sequence: Synthetic polypeptide
HSQGTFTSDYSKYLDSRRAQDFVQWLMNTGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 810 - protein, 570 aa, Artificial Sequence
  Description of Artificial Sequence: Synthetic polypeptide
HSQGTFTSDYSKYLDSRRAQDFVQWLMNTGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 811 - protein, 606 aa, Artificial Sequence
  Description of Artificial Sequence: Synthetic polypeptide
HSQGTFTSDYSKYLDSRRAQDFVQWLMNTGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 812 - protein, 606 aa, Artificial Sequence
  Description of Artificial Sequence: Synthetic polypeptide
HSQGTFTSDYSKYLDSRRAQDFVQWLMNTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 813 - protein, 606 aa, Artificial Sequence
  Description of Artificial Sequence: Synthetic polypeptide
HSQGTFTSDYSKYLDSRRAQDFVQWLMNTGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 814 - protein, 866 aa, Artificial Sequence
  Description of Artificial Sequence: Synthetic polypeptide
HSQGTFTSDYSKYLDSRRAQDFVQWLMNTGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 815 - protein, 894 aa, Artificial Sequence
  Description of Artificial Sequence: Synthetic polypeptide
HSQGTFTSDYSKYLDSRRAQDFVQWLMNTGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 816 - protein, 905 aa, Artificial Sequence
  Description of Artificial Sequence: Synthetic polypeptide
  MOD_RES (460)..(462): Any amino acid
  MOD_RES (473)..(476): Any amino acid
HSQGTFTSDYSKYLDSRRAQDFVQWLMNTGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 817 - protein, 894 aa, Artificial Sequence
  Description of Artificial Sequence: Synthetic polypeptide
HSQGTFTSDYSKYLDSRRAQDFVQWLMNTGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 818 - protein, 905 aa, Artificial Sequence
  Description of Artificial Sequence: Synthetic polypeptide
HSQGTFTSDYSKYLDSRRAQDFVQWLMNTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 819 - protein, 1348 aa, Artificial Sequence
  Description of Artificial Sequence: Synthetic polypeptide
HSQGTFTSDYSKYLDSRRAQDFVQWLMNTGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 820 - protein, 894 aa, Artificial Sequence
  Description of Artificial Sequence: Synthetic polypeptide
HSQGTFTSDYSKYLDSRRAQDFVQWLMNTGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 821 - protein, 894 aa, Artificial Sequence
  Description of Artificial Sequence: Synthetic polypeptide
HSQGTFTSDYSKYLDSRRAQDFVQWLMNTGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 822 - protein, 66 aa, Artificial Sequence
  Description of Artificial Sequence: Synthetic polypeptide
GEGSGEGSEGEGSEGSGEGEGSEGGSEGEGGSEGSEGHSQGTFTSDYSKYLDSRRAQDFVQWLMNT

SEQ ID NO: 823 - protein, 102 aa, Artificial Sequence
  Description of Artificial Sequence: Synthetic polypeptide
GEGSGEGSEGEGSEGSGEGEGSEGSGEGEGGSEGSEGEGGSEGSEGEGSEGGSEGEGGSEGSEGEGSEGGGEGHSQGTFTSDYSKYLDSRRAQDFVQWLMNT

SEQ ID NO: 824 - protein, 174 aa, Artificial Sequence
  Description of Artificial Sequence: Synthetic polypeptide
GEGGSEGSEGEGSEGSGEGEGGSEGSEGEGSEGSGEGEGGSEGSEGEGGSEGSEGEGGEGSGEGEGSEGSGEGEGSGEGSEGEGGSEGGEGEGSEGGSEGEGSEGGSEGEGGEGSGEGEGGGEGSEGEGSEGSGEGEGSGEGSEGHSQGTFTSDYSKYLDSRRAQDFVQWLMNT

SEQ ID NO: 825 - protein, 318 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGHSQGTFTSDYSKYLDSRRAQDFVQWLMNT

SEQ ID NO: 826 - protein, 174 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGHSQGTFTSDYSKYLDSRRAQDFVQWLMNT

SEQ ID NO: 827 - protein, 174 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHSQGTFTSDYSKYLDSRRAQDFVQWLMNT

SEQ ID NO: 828 - protein, 318 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNT

SEQ ID NO: 829 - protein, 534 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGHSQGTFTSDYSKYLDSRRAQDFVQWLMNT

SEQ ID NO: 830 - protein, 570 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGHSQGTFTSDYSKYLDSRRAQDFVQWLMNT

SEQ ID NO: 831 - protein, 606 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHSQGTFTSDYSKYLDSRRAQDFVQWLMNT

SEQ ID NO: 832 - protein, 606 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNT

SEQ ID NO: 833 - protein, 606 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHSQGTFTSDYSKYLDSRRAQDFVQWLMNT

SEQ ID NO: 834 - protein, 866 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHSQGTFTSDYSKYLDSRRAQDFVQWLMNT

SEQ ID NO: 835 - protein, 894 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNT

SEQ ID NO: 836 - protein, 905 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHSQGTFTSDYSKYLDSRRAQDFVQWLMNT

SEQ ID NO: 837 - protein, 894 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHSQGTFTSDYSKYLDSRRAQDFVQWLMNT

SEQ ID NO: 838 - protein, 905 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNT

SEQ ID NO: 839 - protein, 943 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNT

SEQ ID NO: 840 - protein, 954 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNT

SEQ ID NO: 841 - protein, 1348 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGHSQGTFTSDYSKYLDSRRAQDFVQWLMNT

SEQ ID NO: 842 - protein, 894 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGHSQGTFTSDYSKYLDSRRAQDFVQWLMNT

SEQ ID NO: 843 - protein, 894 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGHSQGTFTSDYSKYLDSRRAQDFVQWLMNT

SEQ ID NO: 844 - protein, 197 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 845 - protein, 197 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 846 - protein, 341 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 847 - protein, 557 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 848 - protein, 593 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 849 - protein, 629 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 850 - protein, 629 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 851 - protein, 629 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 852 - protein, 889 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 853 - protein, 917 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 854 - protein, 928 aa, Artificial Sequence
  Description of Artificial Sequence: Synthetic polypeptide
  MOD_RES (483)..(485): Any amino acid
  MOD_RES (496)..(499): Any amino acid
YRQSMNNFQGLRSFGCRFGTCTVQKLAHQIYQFTDKDKDNVAPRSKISPQGYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 855 - protein, 917 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 856 - protein, 928 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 857 - protein, 1371 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 858 - protein, 917 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 859 - protein, 917 aa, Artificial Sequence
  Description of Artificial Sequence: Synthetic polypeptide
YRQSMNNFQGLRSFGCRFGTCTVQKLAHQIYQFTDKDKDNVAPRSKISPQGYGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 860 - protein, 197 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGYRQSMNNFQGLRSFGCRFGTCTVQKLAHQIYQFTDKDKDNVAPRSKISPQGY

SEQ ID NO: 861 - protein, 197 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGYRQSMNNFQGLRSFGCRFGTCTVQKLAHQIYQFTDKDKDNVAPRSKISPQGY

SEQ ID NO: 862 - protein, 341 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYRQSMNNFQGLRSFGCRFGTCTVQKLAHQIYQFTDKDKDNVAPRSKISPQGY

SEQ ID NO: 863 - protein, 557 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGYRQSMNNFQGLRSFGCRFGTCTVQKLAHQIYQFTDKDKDNVAPRSKISPQGY

SEQ ID NO: 864 - protein, 593 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGYRQSMNNFQGLRSFGCRFGTCTVQKLAHQIYQFTDKDKDNVAPRSKISPQGY

SEQ ID NO: 865 - protein, 629 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGYRQSMNNFQGLRSFGCRFGTCTVQKLAHQIYQFTDKDKDNVAPRSKISPQGY

SEQ ID NO: 866 - protein, 629 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGYRQSMNNFQGLRSFGCRFGTCTVQKLAHQIYQFTDKDKDNVAPRSKISPQGY

SEQ ID NO: 867 - protein, 629 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGYRQSMNNFQGLRSFGCRFGTCTVQKLAHQIYQFTDKDKDNVAPRSKISPQGY

SEQ ID NO: 868 - protein, 889 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGYRQSMNNFQGLRSFGCRFGTCTVQKLAHQIYQFTDKDKDNVAPRSKISPQGY

SEQ ID NO: 869 - protein, 917 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYRQSMNNFQGLRSFGCRFGTCTVQKLAHQIYQFTDKDKDNVAPRSKISPQGY

SEQ ID NO: 870 - protein, 928 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGYRQSMNNFQGLRSFGCRFGTCTVQKLAHQIYQFTDKDKDNVAPRSKISPQGY

SEQ ID NO: 871 - protein, 917 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGYRQSMNNFQGLRSFGCRFGTCTVQKLAHQIYQFTDKDKDNVAPRSKISPQGY

SEQ ID NO: 872 - protein, 928 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYRQSMNNFQGLRSFGCRFGTCTVQKLAHQIYQFTDKDKDNVAPRSKISPQGY

SEQ ID NO: 873 - protein, 966 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYRQSMNNFQGLRSFGCRFGTCTVQKLAHQIYQFTDKDKDNVAPRSKISPQGY

SEQ ID NO: 874 - protein, 977 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYRQSMNNFQGLRSFGCRFGTCTVQKLAHQIYQFTDKDKDNVAPRSKISPQGY

SEQ ID NO: 875 - protein, 1371 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGYRQSMNNFQGLRSFGCRFGTCTVQKLAHQIYQFTDKDKDNVAPRSKISPQGY

SEQ ID NO: 876 - protein, 917 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGYRQSMNNFQGLRSFGCRFGTCTVQKLAHQIYQFTDKDKDNVAPRSKISPQGY

SEQ ID NO: 877 - protein, 917 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGYRQSMNNFQGLRSFGCRFGTCTVQKLAHQIYQFTDKDKDNVAPRSKISPQGY

SEQ ID NO: 878 - protein, 182 aa, Artificial Sequence
  Description of Artificial Sequence: Synthetic polypeptide
KCNTATCATQRLANFLVHSSNNFGAILSSTNVGSNTYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 879 - protein, 182 aa, Artificial Sequence
  Description of Artificial Sequence: Synthetic polypeptide
KCNTATCATQRLANFLVHSSNNFGAILSSTNVGSNTYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 880 - protein, 326 aa, Artificial Sequence
  Description of Artificial Sequence: Synthetic polypeptide
KCNTATCATQRLANFLVHSSNNFGAILSSTNVGSNTYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 881 - protein, 542 aa, Artificial Sequence
  Description of Artificial Sequence: Synthetic polypeptide
KCNTATCATQRLANFLVHSSNNFGAILSSTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 882 - protein, 578 aa, Artificial Sequence
  Description of Artificial Sequence: Synthetic polypeptide
KCNTATCATQRLANFLVHSSNNFGAILSSTNVGSNTYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 883 - protein, 614 aa, Artificial Sequence
  Description of Artificial Sequence: Synthetic polypeptide
KCNTATCATQRLANFLVHSSNNFGAILSSTNVGSNTYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 884 - protein, 614 aa, Artificial Sequence
  Description of Artificial Sequence: Synthetic polypeptide
KCNTATCATQRLANFLVHSSNNFGAILSSTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 885 - protein, 615 aa, Artificial Sequence
  Description of Artificial Sequence: Synthetic polypeptide
KCNTATCATNRLANFLVHSSNNFGGILGGTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 886 - protein, 614 aa, Artificial Sequence
  Description of Artificial Sequence: Synthetic polypeptide
KCNTATCATQRLANFLVHSSNNFGAILSSTNVGSNTYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 887 - protein, 874 aa, Artificial Sequence
  Description of Artificial Sequence: Synthetic polypeptide
KCNTATCATQRLANFLVHSSNNFGAILSSTNVGSNTYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 888 - protein, 902 aa, Artificial Sequence
  Description of Artificial Sequence: Synthetic polypeptide
KCNTATCATQRLANFLVHSSNNFGAILSSTNVGSNTYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 889 - protein, 913 aa, Artificial Sequence
  Description of Artificial Sequence: Synthetic polypeptide
  MOD_RES (468)..(470): Any amino acid
  MOD_RES (481)..(484): Any amino acid
KCNTATCATQRLANFLVHSSNNFGAILSSTNVGSNTYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 890 - protein, 902 aa, Artificial Sequence
  Description of Artificial Sequence: Synthetic polypeptide
KCNTATCATQRLANFLVHSSNNFGAILSSTNVGSNTYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 891 - protein, 913 aa, Artificial Sequence
  Description of Artificial Sequence: Synthetic polypeptide
KCNTATCATQRLANFLVHSSNNFGAILSSTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 892 - protein, 1356 aa, Artificial Sequence
  Description of Artificial Sequence: Synthetic polypeptide
KCNTATCATQRLANFLVHSSNNFGAILSSTNVGSNTYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 893 - protein, 902 aa, Artificial Sequence
  Description of Artificial Sequence: Synthetic polypeptide
KCNTATCATQRLANFLVHSSNNFGAILSSTNVGSNTYGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 894 - protein, 902 aa, Artificial Sequence
  Description of Artificial Sequence: Synthetic polypeptide
KCNTATCATQRLANFLVHSSNNFGAILSSTNVGSNTYGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 895 - protein, 182 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGKCNTATCATQRLANFLVHSSNNFGAILSSTNVGSNTY

SEQ ID NO: 896 - protein, 182 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGKCNTATCATQRLANFLVHSSNNFGAILSSTNVGSNTY

SEQ ID NO: 897 - protein, 326 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTY

SEQ ID NO: 898 - protein, 542 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGKCNTATCATQRLANFLVHSSNNFGAILSSTNVGSNTY

SEQ ID NO: 899 - protein, 578 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGKCNTATCATQRLANFLVHSSNNFGAILSSTNVGSNTY

SEQ ID NO: 900 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGKCNTATCATQRLANFLVHSSNNFGAILSSTNVGSNTY

SEQ ID NO: 901 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATQRLANFLVHSSNNFGAILSSTNVGSNTY

SEQ ID NO: 902 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKCNTATCATNRLANFLVHSSNNFGGILGGTNVGSNTY

SEQ ID NO: 903 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGKCNTATCATQRLANFLVHSSNNFGAILSSTNVGSNTY

SEQ ID NO: 904 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGKCNTATCATQRLANFLVHSSNNFGAILSSTNVGSNTY

SEQ ID NO: 905 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTY

SEQ ID NO: 906 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGKCNTATCATQRLANFLVHSSNNFGAILSSTNVGSNTY

SEQ ID NO: 907 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGKCNTATCATQRLANFLVHSSNNFGAILSSTNVGSNTY

SEQ ID NO: 908 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTY

SEQ ID NO: 909 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKCNTATCATQRLANFLVHSSNNFGAILSSTNVGSNTY

SEQ ID NO: 910 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKCNTATCATQRLANFLVHSSNNFGAILSSTNVGSNTY

SEQ ID NO: 911 - protein, 1356 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGKCNTATCATQRLANFLVHSSNNFGAILSSTNVGSNTY

SEQ ID NO: 912 - protein, 902 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGKCNTATCATQRLANFLVHSSNNFGAILSSTNVGSNTY

SEQ ID NO: 913 - protein, 902 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGKCNTATCATQRLANFLVHSSNNFGAILSSTNVGSNTY

SEQ ID NO: 914 - protein, 177 aa, Artificial Sequence
  Description of Artificial Sequence: Synthetic polypeptide
CGNLSTCMLGTYTQDFNKFHTFPQTAIGVGAPGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 915 - protein, 177 aa, Artificial Sequence
  Description of Artificial Sequence: Synthetic polypeptide
CGNLSTCMLGTYTQDFNKFHTFPQTAIGVGAPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 916 - protein, 321 aa, Artificial Sequence
  Description of Artificial Sequence: Synthetic polypeptide
CGNLSTCMLGTYTQDFNKFHTFPQTAIGVGAPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 917 - protein, 537 aa, Artificial Sequence
  Description of Artificial Sequence: Synthetic polypeptide
CGNLSTCMLGTYTQDFNKFHTFPQTAIGVGAPGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 918 - protein, 573 aa, Artificial Sequence
  Description of Artificial Sequence: Synthetic polypeptide
CGNLSTCMLGTYTQDFNKFHTFPQTAIGVGAPGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 919 - protein, 609 aa, Artificial Sequence
  Description of Artificial Sequence: Synthetic polypeptide
CGNLSTCMLGTYTQDFNKFHTFPQTAIGVGAPGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 920 - protein, 609 aa, Artificial Sequence
  Description of Artificial Sequence: Synthetic polypeptide
CGNLSTCMLGTYTQDFNKFHTFPQTAIGVGAPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 921 - protein, 609 aa, Artificial Sequence
  Description of Artificial Sequence: Synthetic polypeptide
CGNLSTCMLGTYTQDFNKFHTFPQTAIGVGAPGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 922 - protein, 869 aa, Artificial Sequence
  Description of Artificial Sequence: Synthetic polypeptide
CGNLSTCMLGTYTQDFNKFHTFPQTAIGVGAPGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 923 - protein, 897 aa, Artificial Sequence
  Description of Artificial Sequence: Synthetic polypeptide
CGNLSTCMLGTYTQDFNKFHTFPQTAIGVGAPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 924 - protein, 908 aa, Artificial Sequence
  Description of Artificial Sequence: Synthetic polypeptide
  MOD_RES (463)..(465): Any amino acid
  MOD_RES (476)..(479): Any amino acid
CGNLSTCMLGTYTQDFNKFHTFPQTAIGVGAPGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 925 - protein, 897 aa, Artificial Sequence
  Description of Artificial Sequence: Synthetic polypeptide
CGNLSTCMLGTYTQDFNKFHTFPQTAIGVGAPGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 926 - protein, 908 aa, Artificial Sequence
  Description of Artificial Sequence: Synthetic polypeptide
CGNLSTCMLGTYTQDFNKFHTFPQTAIGVGAPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 927 - protein, 1351 aa, Artificial Sequence
  Description of Artificial Sequence: Synthetic polypeptide
CGNLSTCMLGTYTQDFNKFHTFPQTAIGVGAPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 928 - protein, 897 aa, Artificial Sequence
  Description of Artificial Sequence: Synthetic polypeptide
CGNLSTCMLGTYTQDFNKFHTFPQTAIGVGAPGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 929 - protein, 897 aa, Artificial Sequence
  Description of Artificial Sequence: Synthetic polypeptide
CGNLSTCMLGTYTQDFNKFHTFPQTAIGVGAPGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 930 - protein, 177 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGCGNLSTCMLGTYTQDFNKFHTFPQTAIGVGAP

SEQ ID NO: 931 - protein, 177 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGCGNLSTCMLGTYTQDFNKFHTFPQTAIGVGAP

SEQ ID NO: 932 - protein, 321 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGCGNLSTCMLGTYTQDFNKFHTFPQTAIGVGAP

SEQ ID NO: 933 - protein, 537 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGCGNLSTCMLGTYTQDFNKFHTFPQTAIGVGAP

SEQ ID NO: 934 - protein, 573 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGCGNLSTCMLGTYTQDFNKFHTFPQTAIGVGAP

SEQ ID NO: 935 - protein, 609 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGCGNLSTCMLGTYTQDFNKFHTFPQTAIGVGAP

SEQ ID NO: 936 - protein, 609 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGCGNLSTCMLGTYTQDFNKFHTFPQTAIGVGAP

SEQ ID NO: 937 - protein, 609 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGCGNLSTCMLGTYTQDFNKFHTFPQTAIGVGAP

SEQ ID NO: 938 - protein, 869 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGCGNLSTCMLGTYTQDFNKFHTFPQTAIGVGAP

SEQ ID NO: 939 - protein, 897 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGCGNLSTCMLGTYTQDFNKFHTFPQTAIGVGAP

SEQ ID NO: 940 - protein, 908 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGCGNLSTCMLGTYTQDFNKFHTFPQTAIGVGAP

SEQ ID NO: 941 - protein, 897 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGCGNLSTCMLGTYTQDFNKFHTFPQTAIGVGAP

SEQ ID NO: 942 - protein, 908 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGCGNLSTCMLGTYTQDFNKFHTFPQTAIGVGAP

SEQ ID NO: 943 - protein, 946 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGCGNLSTCMLGTYTQDFNKFHTFPQTAIGVGAP

SEQ ID NO: 944 - protein, 957 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGCGNLSTCMLGTYTQDFNKFHTFPQTAIGVGAP

SEQ ID NO: 945 - protein, 1351 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGCGNLSTCMLGTYTQDFNKFHTFPQTAIGVGAP

SEQ ID NO: 946 - protein, 897 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGCGNLSTCMLGTYTQDFNKFHTFPQTAIGVGAP

SEQ ID NO: 947 - protein, 897 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGCGNLSTCMLGTYTQDFNKFHTFPQTAIGVGAP

SEQ ID NO: 948 - protein, 181 aa, Artificial Sequence
  Description of Artificial Sequence: Synthetic polypeptide
ACDTATCVTHRLAGLLSRSGGVVKNMVPTNVGSKAFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 949 - protein, 181 aa, Artificial Sequence
  Description of Artificial Sequence: Synthetic polypeptide
ACDTATCVTHRLAGLLSRSGGVVKNMVPTNVGSKAFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 950 - protein, 325 aa, Artificial Sequence
  Description of Artificial Sequence: Synthetic polypeptide
ACDTATCVTHRLAGLLSRSGGVVKNMVPTNVGSKAFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 951 - protein, 541 aa, Artificial Sequence
  Description of Artificial Sequence: Synthetic polypeptide
ACDTATCVTHRLAGLLSRSGGVVKNMVPTNVGSKAFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 952 - protein, 577 aa, Artificial Sequence
  Description of Artificial Sequence: Synthetic polypeptide
ACDTATCVTHRLAGLLSRSGGVVKNMVPTNVGSKAFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 953 - protein, 613 aa, Artificial Sequence
  Description of Artificial Sequence: Synthetic polypeptide
ACDTATCVTHRLAGLLSRSGGVVKNMVPTNVGSKAFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 954 - protein, 613 aa, Artificial Sequence
  Description of Artificial Sequence: Synthetic polypeptide
ACDTATCVTHRLAGLLSRSGGVVKNMVPTNVGSKAFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 955 - protein, 613 aa, Artificial Sequence
  Description of Artificial Sequence: Synthetic polypeptide
ACDTATCVTHRLAGLLSRSGGVVKNMVPTNVGSKAFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 956 - protein, 873 aa, Artificial Sequence
  Description of Artificial Sequence: Synthetic polypeptide
ACDTATCVTHRLAGLLSRSGGVVKNMVPTNVGSKAFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 957 - protein, 901 aa, Artificial Sequence
  Description of Artificial Sequence: Synthetic polypeptide
ACDTATCVTHRLAGLLSRSGGVVKNMVPTNVGSKAFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 958 - protein, 912 aa, Artificial Sequence
  Description of Artificial Sequence: Synthetic polypeptide
  MOD_RES (467)..(469): Any amino acid
  MOD_RES (480)..(483): Any amino acid
ACDTATCVTHRLAGLLSRSGGVVKNMVPTNVGSKAFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 959 - protein, 901 aa, Artificial Sequence
  Description of Artificial Sequence: Synthetic polypeptide
ACDTATCVTHRLAGLLSRSGGVVKNMVPTNVGSKAFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 960 - protein, 912 aa, Artificial Sequence
  Description of Artificial Sequence: Synthetic polypeptide
ACDTATCVTHRLAGLLSRSGGVVKNMVPTNVGSKAFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 961 - protein, 1355 aa, Artificial Sequence
  Description of Artificial Sequence: Synthetic polypeptide
ACDTATCVTHRLAGLLSRSGGVVKNMVPTNVGSKAFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 962 - protein, 901 aa, Artificial Sequence
  Description of Artificial Sequence: Synthetic polypeptide
ACDTATCVTHRLAGLLSRSGGVVKNMVPTNVGSKAFGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 963 - protein, 901 aa, Artificial Sequence
  Description of Artificial Sequence: Synthetic polypeptide
ACDTATCVTHRLAGLLSRSGGVVKNMVPTNVGSKAFGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 964 - protein, 181 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGACDTATCVTHRLAGLLSRSGGVVKNMVPTNVGSKAF

SEQ ID NO: 965 - protein, 181 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGACDTATCVTHRLAGLLSRSGGVVKNMVPTNVGSKAF

SEQ ID NO: 966 - protein, 325 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGACDTATCVTHRLAGLLSRSGGVVKNMVPTNVGSKAF

SEQ ID NO: 967 - protein, 541 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGACDTATCVTHRLAGLLSRSGGVVKNMVPTNVGSKAF

SEQ ID NO: 968 - protein, 577 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGACDTATCVTHRLAGLLSRSGGVVKNMVPTNVGSKAF

SEQ ID NO: 969 - protein, 613 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGACDTATCVTHRLAGLLSRSGGVVKNMVPTNVGSKAF

SEQ ID NO: 970 - protein, 613 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGACDTATCVTHRLAGLLSRSGGVVKNMVPTNVGSKAF

SEQ ID NO: 971 - protein, 613 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGACDTATCVTHRLAGLLSRSGGVVKNMVPTNVGSKAF

SEQ ID NO: 972 - protein, 873 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGACDTATCVTHRLAGLLSRSGGVVKNMVPTNVGSKAF

SEQ ID NO: 973 - protein, 901 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGACDTATCVTHRLAGLLSRSGGVVKNMVPTNVGSKAF

SEQ ID NO: 974 - protein, 912 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGACDTATCVTHRLAGLLSRSGGVVKNMVPTNVGSKAF

SEQ ID NO: 975 - protein, 901 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGACDTATCVTHRLAGLLSRSGGVVKNMVPTNVGSKAF

SEQ ID NO: 976 - protein, 912 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGACDTATCVTHRLAGLLSRSGGVVKNMVPTNVGSKAF

SEQ ID NO: 977 - protein, 950 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGACDTATCVTHRLAGLLSRSGGVVKNMVPTNVGSKAF

SEQ ID NO: 978 - protein, 961 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGACDTATCVTHRLAGLLSRSGGVVKNMVPTNVGSKAF

SEQ ID NO: 979 - protein, 1355 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGACDTATCVTHRLAGLLSRSGGVVKNMVPTNVGSKAF

SEQ ID NO: 980 - protein, 901 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGACDTATCVTHRLAGLLSRSGGVVKNMVPTNVGSKAF

SEQ ID NO: 981 - protein, 901 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGACDTATCVTHRLAGLLSRSGGVVKNMVPTNVGSKAF

SEQ ID NO: 982 - protein, 178 aa, Artificial Sequence
  Description of Artificial Sequence: Synthetic polypeptide
KAPSGRMSIVKNLQNLDPSHRISDRDYMGWMDFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 983 - protein, 178 aa, Artificial Sequence
  Description of Artificial Sequence: Synthetic polypeptide
KAPSGRMSIVKNLQNLDPSHRISDRDYMGWMDFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 984 - protein, 322 aa, Artificial Sequence
  Description of Artificial Sequence: Synthetic polypeptide
KAPSGRMSIVKNLQNLDPSHRISDRDYMGWMDFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 985 - protein, 538 aa, Artificial Sequence
  Description of Artificial Sequence: Synthetic polypeptide
KAPSGRMSIVKNLQNLDPSHRISDRDYMGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 986 - protein, 574 aa, Artificial Sequence
  Description of Artificial Sequence: Synthetic polypeptide
KAPSGRMSIVKNLQNLDPSHRISDRDYMGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 987 - protein, 610 aa, Artificial Sequence
  Description of Artificial Sequence: Synthetic polypeptide
KAPSGRMSIVKNLQNLDPSHRISDRDYMGWMDFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 988 - protein, 610 aa, Artificial Sequence
  Description of Artificial Sequence: Synthetic polypeptide
KAPSGRMSIVKNLQNLDPSHRISDRDYMGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 989 - protein, 610 aa, Artificial Sequence
  Description of Artificial Sequence: Synthetic polypeptide
KAPSGRMSIVKNLQNLDPSHRISDRDYMGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 990 - protein, 870 aa, Artificial Sequence
  Description of Artificial Sequence: Synthetic polypeptide
KAPSGRMSIVKNLQNLDPSHRISDRDYMGWMDFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 991 - protein, 898 aa, Artificial Sequence
  Description of Artificial Sequence: Synthetic polypeptide
KAPSGRMSIVKNLQNLDPSHRISDRDYMGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 992 - protein, 909 aa, Artificial Sequence
  Description of Artificial Sequence: Synthetic polypeptide
  MOD_RES (464)..(466): Any amino acid
  MOD_RES (477)..(480): Any amino acid
KAPSGRMSIVKNLQNLDPSHRISDRDYMGWMDFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 993 - protein, 898 aa, Artificial Sequence
  Description of Artificial Sequence: Synthetic polypeptide
KAPSGRMSIVKNLQNLDPSHRISDRDYMGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 994 - protein, 909 aa, Artificial Sequence
  Description of Artificial Sequence: Synthetic polypeptide
KAPSGRMSIVKNLQNLDPSHRISDRDYMGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 995 - protein, 1352 aa, Artificial Sequence
  Description of Artificial Sequence: Synthetic polypeptide
KAPSGRMSIVKNLQNLDPSHRISDRDYMGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 996 - protein, 898 aa, Artificial Sequence
  Description of Artificial Sequence: Synthetic polypeptide
KAPSGRMSIVKNLQNLDPSHRISDRDYMGWMDFGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 997 - protein, 898 aa, Artificial Sequence
  Description of Artificial Sequence: Synthetic polypeptide
KAPSGRMSIVKNLQNLDPSHRISDRDYMGWMDFGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 998 - protein, 178 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGKAPSGRMSIVKNLQNLDPSHRISDRDYMGWMDF

SEQ ID NO: 999 - protein, 178 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGKAPSGRMSIVKNLQNLDPSHRISDRDYMGWMDF

SEQ ID NO: 1000 - protein, 322 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKAPSGRMSIVKNLQNLDPSHRISDRDYMGWMDF

SEQ ID NO: 1001 - protein, 538 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGKAPSGRMSIVKNLQNLDPSHRISDRDYMGWMDF

SEQ ID NO: 1002 - protein, 574 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGKAPSGRMSIVKNLQNLDPSHRISDRDYMGWMDF

SEQ ID NO: 1003 - protein, 610 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGKAPSGRMSIVKNLQNLDPSHRISDRDYMGWMDF

SEQ ID NO: 1004 - protein, 610 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGKAPSGRMSIVKNLQNLDPSHRISDRDYMGWMDF

SEQ ID NO: 1005 - protein, 610 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGKAPSGRMSIVKNLQNLDPSHRISDRDYMGWMDF

SEQ ID NO: 1006 - protein, 870 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGKAPSGRMSIVKNLQNLDPSHRISDRDYMGWMDF

SEQ ID NO: 1007 - protein, 898 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKAPSGRMSIVKNLQNLDPSHRISDRDYMGWMDF

SEQ ID NO: 1008 - protein, 909 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGKAPSGRMSIVKNLQNLDPSHRISDRDYMGWMDF

SEQ ID NO: 1009 - protein, 898 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGKAPSGRMSIVKNLQNLDPSHRISDRDYMGWMDF

SEQ ID NO: 1010 - protein, 909 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKAPSGRMSIVKNLQNLDPSHRISDRDYMGWMDF

SEQ ID NO: 1011 - protein, 947 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGKAPSGRMSIVKNLQNLDPSHRISDRDYMGWMDF

SEQ ID NO: 1012 - protein, 958 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGKAPSGRMSIVKNLQNLDPSHRISDRDYMGWMDF

SEQ ID NO: 1013 - protein, 1352 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGKAPSGRMSIVKNLQNLDPSHRISDRDYMGWMDF

SEQ ID NO: 1014 - protein, 898 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGKAPSGRMSIVKNLQNLDPSHRISDRDYMGWMDF

SEQ ID NO: 1015 - protein, 898 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGKAPSGRMSIVKNLQNLDPSHRISDRDYMGWMDF

SEQ ID NO: 1016 - protein, 153 aa, Artificial Sequence
  Description of Artificial Sequence: Synthetic polypeptide
DYMGWMDFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1017 - protein, 153 aa, Artificial Sequence
  Description of Artificial Sequence: Synthetic polypeptide
DYMGWMDFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1018 - protein, 297 aa, Artificial Sequence
  Description of Artificial Sequence: Synthetic polypeptide
DYMGWMDFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1019 - protein, 513 aa, Artificial Sequence
  Description of Artificial Sequence: Synthetic polypeptide
DYMGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1020 - protein, 549 aa, Artificial Sequence
  Description of Artificial Sequence: Synthetic polypeptide
DYMGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1021 - protein, 585 aa, Artificial Sequence
  Description of Artificial Sequence: Synthetic polypeptide
DYMGWMDFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1022 - protein, 585 aa, Artificial Sequence
  Description of Artificial Sequence: Synthetic polypeptide
DYMGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1023 - protein, 585 aa, Artificial Sequence
  Description of Artificial Sequence: Synthetic polypeptide
DYMGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1024 - protein, 845 aa, Artificial Sequence
  Description of Artificial Sequence: Synthetic polypeptide
DYMGWMDFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1025 - protein, 873 aa, Artificial Sequence
  Description of Artificial Sequence: Synthetic polypeptide
DYMGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1026 - protein, 884 aa, Artificial Sequence
  Description of Artificial Sequence: Synthetic polypeptide
  MOD_RES (439)..(441): Any amino acid
  MOD_RES (452)..(455): Any amino acid
DYMGWMDFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1027 - protein, 873 aa, Artificial Sequence
  Description of Artificial Sequence: Synthetic polypeptide
DYMGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1028 - protein, 884 aa, Artificial Sequence
  Description of Artificial Sequence: Synthetic polypeptide
DYMGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1029 - protein, 1327 aa, Artificial Sequence
  Description of Artificial Sequence: Synthetic polypeptide
DYMGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1030 - protein, 873 aa, Artificial Sequence
  Description of Artificial Sequence: Synthetic polypeptide
DYMGWMDFGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1031 - protein, 873 aa, Artificial Sequence
  Description of Artificial Sequence: Synthetic polypeptide
DYMGWMDFGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1032 - protein, 153 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGDYMGWMDF

SEQ ID NO: 1033 - protein, 153 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGDYMGWMDF

SEQ ID NO: 1034 - protein, 297 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDYMGWMDF

SEQ ID NO: 1035 - protein, 513 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGDYMGWMDF

SEQ ID NO: 1036 - protein, 549 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGDYMGWMDF

SEQ ID NO: 1037 - protein, 585 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGDYMGWMDF

SEQ ID NO: 1038 - protein, 585 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGDYMGWMDF

SEQ ID NO: 1039 - protein, 585 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGDYMGWMDF

SEQ ID NO: 1040 - protein, 845 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGDYMGWMDF

SEQ ID NO: 1041 - protein, 873 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDYMGWMDF

SEQ ID NO: 1042 - protein, 884 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGDYMGWMDF

SEQ ID NO: 1043 - protein, 873 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGDYMGWMDF

SEQ ID NO: 1044 - protein, 884 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGDYMGWMDF

SEQ ID NO: 1045 - protein, 922 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDYMGWMDF

SEQ ID NO: 1046 - protein, 933 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGDYMGWMDF

SEQ ID NO: 1047 - protein, 1327 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGDYMGWMDF

SEQ ID NO: 1048 - protein, 873 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGDYMGWMDF

SEQ ID NO: 1049 - protein, 873 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGDYMGWMDF

SEQ ID NO: 1050 - protein, 184 aa, Artificial Sequence
  Description of Artificial Sequence: Synthetic polypeptide
HGEGTFTSDLSKQMEEEAVRLFIEWLKNGGPSSGAPPPSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1051 - protein, 184 aa, Artificial Sequence
  Description of Artificial Sequence: Synthetic polypeptide
HGEGTFTSDLSKQMEEEAVRLFIEWLKNGGPSSGAPPPSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1052 - protein, 328 aa, Artificial Sequence
  Description of Artificial Sequence: Synthetic polypeptide
HGEGTFTSDLSKQMEEEAVRLFIEWLKNGGPSSGAPPPSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1053 - protein, 544 aa, Artificial Sequence
  Description of Artificial Sequence: Synthetic polypeptide
HGEGTFTSDLSKQMEEEAVRLFIEWLKNGGPSSGAPPPSGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1054 - protein, 580 aa, Artificial Sequence
  Description of Artificial Sequence: Synthetic polypeptide
HGEGTFTSDLSKQMEEEAVRLFIEWLKNGGPSSGAPPPSGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1055 - protein, 616 aa, Artificial Sequence
  Description of Artificial Sequence: Synthetic polypeptide
HGEGTFTSDLSKQMEEEAVRLFIEWLKNGGPSSGAPPPSGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1056 - protein, 616 aa, Artificial Sequence
  Description of Artificial Sequence: Synthetic polypeptide
HGEGTFTSDLSKQMEEEAVRLFIEWLKNGGPSSGAPPPSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1057 - protein, 616 aa, Artificial Sequence
  Description of Artificial Sequence: Synthetic polypeptide
HGEGTFTSDLSKQMEEEAVRLFIEWLKNGGPSSGAPPPSGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1058 - protein, 876 aa, Artificial Sequence
  Description of Artificial Sequence: Synthetic polypeptide
HGEGTFTSDLSKQMEEEAVRLFIEWLKNGGPSSGAPPPSGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1059 - protein, 904 aa, Artificial Sequence
  Description of Artificial Sequence: Synthetic polypeptide
HGEGTFTSDLSKQMEEEAVRLFIEWLKNGGPSSGAPPPSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1060 - protein, 915 aa, Artificial Sequence
  Description of Artificial Sequence: Synthetic polypeptide
  MOD_RES (470)..(472): Any amino acid
  MOD_RES (483)..(486): Any amino acid
HGEGTFTSDLSKQMEEEAVRLFIEWLKNGGPSSGAPPPSGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1061 - protein, 904 aa, Artificial Sequence
  Description of Artificial Sequence: Synthetic polypeptide
HGEGTFTSDLSKQMEEEAVRLFIEWLKNGGPSSGAPPPSGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1062 - protein, 915 aa, Artificial Sequence
  Description of Artificial Sequence: Synthetic polypeptide
HGEGTFTSDLSKQMEEEAVRLFIEWLKNGGPSSGAPPPSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1063 - protein, 1358 aa, Artificial Sequence
  Description of Artificial Sequence: Synthetic polypeptide
HGEGTFTSDLSKQMEEEAVRLFIEWLKNGGPSSGAPPPSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1064 - protein, 904 aa, Artificial Sequence
  Description of Artificial Sequence: Synthetic polypeptide
HGEGTFTSDLSKQMEEEAVRLFIEWLKNGGPSSGAPPPSGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1065 - protein, 904 aa, Artificial Sequence
  Description of Artificial Sequence: Synthetic polypeptide
HGEGTFTSDLSKQMEEEAVRLFIEWLKNGGPSSGAPPPSGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1066 - protein, 184 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGHGEGTFTSDLSKQMEEEAVRLFIEWLKNGGPSSGAPPPS

SEQ ID NO: 1067 - protein, 184 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHGEGTFTSDLSKQMEEEAVRLFIEWLKNGGPSSGAPPPS

SEQ ID NO: 1068 - protein, 328 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPS

SEQ ID NO: 1069 - protein, 544 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGHGEGTFTSDLSKQMEEEAVRLFIEWLKNGGPSSGAPPPS

SEQ ID NO: 1070 - protein, 580 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGHGEGTFTSDLSKQMEEEAVRLFIEWLKNGGPSSGAPPPS

SEQ ID NO: 1071 - protein, 616 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHGEGTFTSDLSKQMEEEAVRLFIEWLKNGGPSSGAPPPS

SEQ ID NO: 1072 - protein, 616 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHGEGTFTSDLSKQMEEEAVRLFIEWLKNGGPSSGAPPPS

SEQ ID NO: 1073 - protein, 616 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHGEGTFTSDLSKQMEEEAVRLFIEWLKNGGPSSGAPPPS

SEQ ID NO: 1074 - protein, 876 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHGEGTFTSDLSKQMEEEAVRLFIEWLKNGGPSSGAPPPS

SEQ ID NO: 1075 - protein, 904 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPS

SEQ ID NO: 1076 - protein, 915 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHGEGTFTSDLSKQMEEEAVRLFIEWLKNGGPSSGAPPPS

SEQ ID NO: 1077 - protein, 904 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHGEGTFTSDLSKQMEEEAVRLFIEWLKNGGPSSGAPPPS

SEQ ID NO: 1078 - protein, 915 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPS

SEQ ID NO: 1079 - protein, 953 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHGEGTFTSDLSKQMEEEAVRLFIEWLKNGGPSSGAPPPS

SEQ ID NO: 1080 - protein, 964 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHGEGTFTSDLSKQMEEEAVRLFIEWLKNGGPSSGAPPPS

SEQ ID NO: 1081 - protein, 1358 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGHGEGTFTSDLSKQMEEEAVRLFIEWLKNGGPSSGAPPPS

SEQ ID NO: 1082 - protein, 904 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGHGEGTFTSDLSKQMEEEAVRLFIEWLKNGGPSSGAPPPS

SEQ ID NO: 1083 - protein, 904 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGHGEGTFTSDLSKQMEEEAVRLFIEWLKNGGPSSGAPPPS

SEQ ID NO: 1084 - protein, 361 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1085 - protein, 361 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1086 - protein, 505 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1087 - protein, 721 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1088 - protein, 757 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1089 - protein, 793 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1090 - protein, 793 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1091 - protein, 793 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1092 - protein, 1053 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1093 - protein, 1081 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1094 - protein, 1092 aa, Artificial Sequence
  Description of Artificial Sequence: Synthetic polypeptide
  MOD_RES (647)..(649): Any amino acid
  MOD_RES (660)..(663): Any amino acid
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1095 - protein, 1081 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1096 - protein, 1092 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1097 - protein, 1535 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1098 - protein, 1081 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1099 - protein, 1081 aa, Artificial Sequence
  Description of Artificial Sequence: Synthetic polypeptide
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1100 - protein, 361 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1101 - protein, 505 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1102 - protein, 721 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1103 - protein, 757 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1104 - protein, 793 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1105 - protein, 793 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1106 - protein, 793 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1107 - protein, 1053 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1108 - protein, 1081 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1109 - protein, 1092 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1110 - protein, 1081 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1111 - protein, 1092 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1112 - protein, 1130 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1113 - protein, 1141 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1114 - protein, 1535 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1115 - protein, 1081 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1116 - protein, 1081 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1117 - protein, 354 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1118 - protein, 354 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1119 - protein, 498 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1120 - protein, 714 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1121 - protein, 750 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1122 - protein, 786 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1123 - protein, 786 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1124 - protein, 786 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1125 - protein, 1046 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1126 - protein, 1074 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1127 - protein, 1085 aa, Artificial Sequence
  Description of Artificial Sequence: Synthetic polypeptide
  MOD_RES (640)..(642): Any amino acid
  MOD_RES (653)..(656): Any amino acid
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1128 - protein, 1074 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1129 - protein, 1085 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1130 - protein, 1528 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1131 - protein, 1074 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1132 - protein, 1074 aa, Artificial Sequence
  Description of Artificial Sequence: Synthetic polypeptide
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1133 - protein, 354 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1134 - protein, 498 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1135 - protein, 714 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1136 - protein, 750 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1137 - protein, 786 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1138 - protein, 786 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1139 - protein, 786 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1140 - protein, 1046 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1141 - protein, 1074 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1142 - protein, 1085 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1143 - protein, 1074 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1144 - protein, 1085 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1145 - protein, 1123 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1146 - protein, 1134 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1147 - protein, 1528 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1148 - protein, 1074 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1149 - protein, 1074 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1150 - protein, 179 aa, Artificial Sequence
  Description of Artificial Sequence: Synthetic polypeptide
QLGPQGPPHLVADPSKKQGPWLEEEEEAYGWMDFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1151 - protein, 179 aa, Artificial Sequence
  Description of Artificial Sequence: Synthetic polypeptide
QLGPQGPPHLVADPSKKQGPWLEEEEEAYGWMDFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1152 - protein, 323 aa, Artificial Sequence
  Description of Artificial Sequence: Synthetic polypeptide
QLGPQGPPHLVADPSKKQGPWLEEEEEAYGWMDFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1153 - protein, 539 aa, Artificial Sequence
  Description of Artificial Sequence: Synthetic polypeptide
QLGPQGPPHLVADPSKKQGPWLEEEEEAYGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1154 - protein, 575 aa, Artificial Sequence
  Description of Artificial Sequence: Synthetic polypeptide
QLGPQGPPHLVADPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1155 - protein, 611 aa, Artificial Sequence
  Description of Artificial Sequence: Synthetic polypeptide
QLGPQGPPHLVADPSKKQGPWLEEEEEAYGWMDFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1156 - protein, 611 aa, Artificial Sequence
  Description of Artificial Sequence: Synthetic polypeptide
QLGPQGPPHLVADPSKKQGPWLEEEEEAYGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1157 - protein, 611 aa, Artificial Sequence
  Description of Artificial Sequence: Synthetic polypeptide
QLGPQGPPHLVADPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1158 - protein, 871 aa, Artificial Sequence
  Description of Artificial Sequence: Synthetic polypeptide
QLGPQGPPHLVADPSKKQGPWLEEEEEAYGWMDFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1159 - protein, 899 aa, Artificial Sequence
  Description of Artificial Sequence: Synthetic polypeptide
QLGPQGPPHLVADPSKKQGPWLEEEEEAYGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1160 - protein, 910 aa, Artificial Sequence
  Description of Artificial Sequence: Synthetic polypeptide
  MOD_RES (465)..(467): Any amino acid
  MOD_RES (478)..(481): Any amino acid
QLGPQGPPHLVADPSKKQGPWLEEEEEAYGWMDFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1161 - protein, 899 aa, Artificial Sequence
  Description of Artificial Sequence: Synthetic polypeptide
QLGPQGPPHLVADPSKKQGPWLEEEEEAYGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1162 - protein, 910 aa, Artificial Sequence
  Description of Artificial Sequence: Synthetic polypeptide
QLGPQGPPHLVADPSKKQGPWLEEEEEAYGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1163 - protein, 1353 aa, Artificial Sequence
  Description of Artificial Sequence: Synthetic polypeptide
QLGPQGPPHLVADPSKKQGPWLEEEEEAYGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1164 - protein, 899 aa, Artificial Sequence
  Description of Artificial Sequence: Synthetic polypeptide
QLGPQGPPHLVADPSKKQGPWLEEEEEAYGWMDFGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1165 - protein, 899 aa, Artificial Sequence
  Description of Artificial Sequence: Synthetic polypeptide
QLGPQGPPHLVADPSKKQGPWLEEEEEAYGWMDFGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1166 - protein, 179 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGQLGPQGPPHLVADPSKKQGPWLEEEEEAYGWMDF

SEQ ID NO: 1167 - protein, 179 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGQLGPQGPPHLVADPSKKQGPWLEEEEEAYGWMDF

SEQ ID NO: 1168 - protein, 323 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQLGPQGPPHLVADPSKKQGPWLEEEEEAYGWMDF

SEQ ID NO: 1169 - protein, 539 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGQLGPQGPPHLVADPSKKQGPWLEEEEEAYGWMDF

SEQ ID NO: 1170 - protein, 575 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGQLGPQGPPHLVADPSKKQGPWLEEEEEAYGWMDF

SEQ ID NO: 1171 - protein, 611 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGQLGPQGPPHLVADPSKKQGPWLEEEEEAYGWMDF

SEQ ID NO: 1172 - protein, 611 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGQLGPQGPPHLVADPSKKQGPWLEEEEEAYGWMDF

SEQ ID NO: 1173 - protein, 611 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGQLGPQGPPHLVADPSKKQGPWLEEEEEAYGWMDF

SEQ ID NO: 1174 - protein, 871 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGQLGPQGPPHLVADPSKKQGPWLEEEEEAYGWMDF

SEQ ID NO: 1175 - protein, 899 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQLGPQGPPHLVADPSKKQGPWLEEEEEAYGWMDF

SEQ ID NO: 1176 - protein, 910 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGQLGPQGPPHLVADPSKKQGPWLEEEEEAYGWMDF

SEQ ID NO: 1177 - protein, 899 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGQLGPQGPPHLVADPSKKQGPWLEEEEEAYGWMDF

SEQ ID NO: 1178 - protein, 910 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQLGPQGPPHLVADPSKKQGPWLEEEEEAYGWMDF

SEQ ID NO: 1179 - protein, 948 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQLGPQGPPHLVADPSKKQGPWLEEEEEAYGWMDF

SEQ ID NO: 1180 - protein, 959 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQLGPQGPPHLVADPSKKQGPWLEEEEEAYGWMDF

SEQ ID NO: 1181 - protein, 1353 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGQLGPQGPPHLVADPSKKQGPWLEEEEEAYGWMDF

SEQ ID NO: 1182 - protein, 899 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGQLGPQGPPHLVADPSKKQGPWLEEEEEAYGWMDF

SEQ ID NO: 1183 - protein, 899 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGQLGPQGPPHLVADPSKKQGPWLEEEEEAYGWMDF

SEQ ID NO: 1184 - protein, 167 aa, Artificial Sequence
  Description of Artificial Sequence: Synthetic polypeptide
DPSKKQGPWLEEEEEAYGWMDFGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1185 - protein, 167 aa, Artificial Sequence
  Description of Artificial Sequence: Synthetic polypeptide
DPSKKQGPWLEEEEEAYGWMDFGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1186 - protein, 311 aa, Artificial Sequence
  Description of Artificial Sequence: Synthetic polypeptide
DPSKKQGPWLEEEEEAYGWMDFGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1187 - protein, 527 aa, Artificial Sequence
  Description of Artificial Sequence: Synthetic polypeptide
DPSKKQGPWLEEEEEAYGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1188 - protein, 563 aa, Artificial Sequence
  Description of Artificial Sequence: Synthetic polypeptide
DPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1189 - protein, 599 aa, Artificial Sequence
  Description of Artificial Sequence: Synthetic polypeptide
DPSKKQGPWLEEEEEAYGWMDFGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1190 - protein, 599 aa, Artificial Sequence
  Description of Artificial Sequence: Synthetic polypeptide
DPSKKQGPWLEEEEEAYGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1191 - protein, 599 aa, Artificial Sequence
  Description of Artificial Sequence: Synthetic polypeptide
DPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1192 - protein, 859 aa, Artificial Sequence
  Description of Artificial Sequence: Synthetic polypeptide
DPSKKQGPWLEEEEEAYGWMDFGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1193 - protein, 887 aa, Artificial Sequence
  Description of Artificial Sequence: Synthetic polypeptide
DPSKKQGPWLEEEEEAYGWMDFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1194 - protein, 898 aa, Artificial Sequence
  Description of Artificial Sequence: Synthetic polypeptide
  MOD_RES (453)..(455): Any amino acid
  MOD_RES (466)..(469): Any amino acid
DPSKKQGPWLEEEEEAYGWMDFGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1195 - protein, 887 aa, Artificial Sequence
  Description of Artificial Sequence: Synthetic polypeptide
DPSKKQGPWLEEEEEAYGWMDFGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1196 - protein, 898 aa, Artificial Sequence
  Description of Artificial Sequence: Synthetic polypeptide
DPSKKQGPWLEEEEEAYGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1197 - protein, 1341 aa, Artificial Sequence
  Description of Artificial Sequence: Synthetic polypeptide
DPSKKQGPWLEEEEEAYGWMDFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1198 - protein, 887 aa, Artificial Sequence
  Description of Artificial Sequence: Synthetic polypeptide
DPSKKQGPWLEEEEEAYGWMDFGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1199 - protein, 887 aa, Artificial Sequence
  Description of Artificial Sequence: Synthetic polypeptide
DPSKKQGPWLEEEEEAYGWMDFGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1200 - protein, 167 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGDPSKKQGPWLEEEEEAYGWMDF

SEQ ID NO: 1201 - protein, 167 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGDPSKKQGPWLEEEEEAYGWMDF

SEQ ID NO: 1202 - protein, 311 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDPSKKQGPWLEEEEEAYGWMDF

SEQ ID NO: 1203 - protein, 527 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGDPSKKQGPWLEEEEEAYGWMDF

SEQ ID NO: 1204 - protein, 563 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGDPSKKQGPWLEEEEEAYGWMDF

SEQ ID NO: 1205 - protein, 599 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGDPSKKQGPWLEEEEEAYGWMDF

SEQ ID NO: 1206 - protein, 599 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGDPSKKQGPWLEEEEEAYGWMDF

SEQ ID NO: 1207 - protein, 599 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGDPSKKQGPWLEEEEEAYGWMDF

SEQ ID NO: 1208 - protein, 859 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGDPSKKQGPWLEEEEEAYGWMDF

SEQ ID NO: 1209 - protein, 887 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDPSKKQGPWLEEEEEAYGWMDF

SEQ ID NO: 1210 - protein, 898 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGDPSKKQGPWLEEEEEAYGWMDF

SEQ ID NO: 1211 - protein, 887 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGDPSKKQGPWLEEEEEAYGWMDF

SEQ ID NO: 1212 - protein, 898 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGDPSKKQGPWLEEEEEAYGWMDF

SEQ ID NO: 1213 - protein, 936 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGDPSKKQGPWLEEEEEAYGWMDF

SEQ ID NO: 1214 - protein, 947 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGDPSKKQGPWLEEEEEAYGWMDF

SEQ ID NO: 1215 - protein, 1341 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGDPSKKQGPWLEEEEEAYGWMDF

SEQ ID NO: 1216 - protein, 887 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGDPSKKQGPWLEEEEEAYGWMDF

SEQ ID NO: 1217 - protein, 887 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGDPSKKQGPWLEEEEEAYGWMDF

SEQ ID NO: 1218 - protein, 187 aa, Artificial Sequence
  Description of Artificial Sequence: Synthetic polypeptide
YAEGTFISDYSIAMDKIHQQDFVNWLLAQKGKKNDWKHNITQGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1219 - protein, 187 aa, Artificial Sequence
  Description of Artificial Sequence: Synthetic polypeptide
YAEGTFISDYSIAMDKIHQQDFVNWLLAQKGKKNDWKHNITQGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1220 - protein, 331 aa, Artificial Sequence
  Description of Artificial Sequence: Synthetic polypeptide
YAEGTFISDYSIAMDKIHQQDFVNWLLAQKGKKNDWKHNITQGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1221 - protein, 547 aa, Artificial Sequence
  Description of Artificial Sequence: Synthetic polypeptide
YAEGTFISDYSIAMDKIHQQDFVNWLLAQKGKKNDWKHNITQGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1222 - protein, 583 aa, Artificial Sequence
  Description of Artificial Sequence: Synthetic polypeptide
YAEGTFISDYSIAMDKIHQQDFVNWLLAQKGKKNDWKHNITQGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1223 - protein, 619 aa, Artificial Sequence
  Description of Artificial Sequence: Synthetic polypeptide
YAEGTFISDYSIAMDKIHQQDFVNWLLAQKGKKNDWKHNITQGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1224 - protein, 619 aa, Artificial Sequence
  Description of Artificial Sequence: Synthetic polypeptide
YAEGTFISDYSIAMDKIHQQDFVNWLLAQKGKKNDWKHNITQGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1225 - protein, 619 aa, Artificial Sequence
  Description of Artificial Sequence: Synthetic polypeptide
YAEGTFISDYSIAMDKIHQQDFVNWLLAQKGKKNDWKHNITQGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1226 - protein, 879 aa, Artificial Sequence
  Description of Artificial Sequence: Synthetic polypeptide
YAEGTFISDYSIAMDKIHQQDFVNWLLAQKGKKNDWKHNITQGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1227 - protein, 907 aa, Artificial Sequence
  Description of Artificial Sequence: Synthetic polypeptide
YAEGTFISDYSIAMDKIHQQDFVNWLLAQKGKKNDWKHNITQGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1228 - protein, 918 aa, Artificial Sequence
  Description of Artificial Sequence: Synthetic polypeptide
  MOD_RES (473)..(475): Any amino acid
  MOD_RES (486)..(489): Any amino acid
YAEGTFISDYSIAMDKIHQQDFVNWLLAQKGKKNDWKHNITQGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1229 - protein, 907 aa, Artificial Sequence
  Description of Artificial Sequence: Synthetic polypeptide
YAEGTFISDYSIAMDKIHQQDFVNWLLAQKGKKNDWKHNITQGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1230 - protein, 918 aa, Artificial Sequence
  Description of Artificial Sequence: Synthetic polypeptide
YAEGTFISDYSIAMDKIHQQDFVNWLLAQKGKKNDWKHNITQGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1231 - protein, 1361 aa, Artificial Sequence
  Description of Artificial Sequence: Synthetic polypeptide
YAEGTFISDYSIAMDKIHQQDFVNWLLAQKGKKNDWKHNITQGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1232 - protein, 907 aa, Artificial Sequence
  Description of Artificial Sequence: Synthetic polypeptide
YAEGTFISDYSIAMDKIHQQDFVNWLLAQKGKKNDWKHNITQGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1233 - protein, 907 aa, Artificial Sequence
  Description of Artificial Sequence: Synthetic polypeptide
YAEGTFISDYSIAMDKIHQQDFVNWLLAQKGKKNDWKHNITQGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1234 - protein, 187 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGYAEGTFISDYSIAMDKIHQQDFVNWLLAQKGKKNDWKHNITQ

SEQ ID NO: 1235 - protein, 187 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGYAEGTFISDYSIAMDKIHQQDFVNWLLAQKGKKNDWKHNITQ

SEQ ID NO: 1236 - protein, 331 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYAEGTFISDYSIAMDKIHQQDFVNWLLAQKGKKNDWKHNITQ

SEQ ID NO: 1237 - protein, 547 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGYAEGTFISDYSIAMDKIHQQDFVNWLLAQKGKKNDWKHNITQ

SEQ ID NO: 1238 - protein, 583 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGYAEGTFISDYSIAMDKIHQQDFVNWLLAQKGKKNDWKHNITQ

SEQ ID NO: 1239 - protein, 619 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGYAEGTFISDYSIAMDKIHQQDFVNWLLAQKGKKNDWKHNITQ

SEQ ID NO: 1240 - protein, 619 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGYAEGTFISDYSIAMDKIHQQDFVNWLLAQKGKKNDWKHNITQ

SEQ ID NO: 1241 - protein, 619 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGYAEGTFISDYSIAMDKIHQQDFVNWLLAQKGKKNDWKHNITQ

SEQ ID NO: 1242 - protein, 879 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGYAEGTFISDYSIAMDKIHQQDFVNWLLAQKGKKNDWKHNITQ

SEQ ID NO: 1243 - protein, 907 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYAEGTFISDYSIAMDKIHQQDFVNWLLAQKGKKNDWKHNITQ

SEQ ID NO: 1244 - protein, 918 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGYAEGTFISDYSIAMDKIHQQDFVNWLLAQKGKKNDWKHNITQ

SEQ ID NO: 1245 - protein, 907 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGYAEGTFISDYSIAMDKIHQQDFVNWLLAQKGKKNDWKHNITQ

SEQ ID NO: 1246 - protein, 918 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYAEGTFISDYSIAMDKIHQQDFVNWLLAQKGKKNDWKHNITQ

SEQ ID NO: 1247 - protein, 956 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYAEGTFISDYSIAMDKIHQQDFVNWLLAQKGKKNDWKHNITQ

SEQ ID NO: 1248 - protein, 967 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYAEGTFISDYSIAMDKIHQQDFVNWLLAQKGKKNDWKHNITQ

SEQ ID NO: 1249 - protein, 1361 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGYAEGTFISDYSIAMDKIHQQDFVNWLLAQKGKKNDWKHNITQ

SEQ ID NO: 1250 - protein, 907 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGYAEGTFISDYSIAMDKIHQQDFVNWLLAQKGKKNDWKHNITQ

SEQ ID NO: 1251 - protein, 907 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGYAEGTFISDYSIAMDKIHQQDFVNWLLAQKGKKNDWKHNITQ

SEQ ID NO: 1252 - protein, 173 aa, Artificial Sequence
  Description of Artificial Sequence: Synthetic polypeptide
GSSFLSPEHQRVQQRKESKKPPAKLQPRGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1253 - protein, 173 aa, Artificial Sequence
  Description of Artificial Sequence: Synthetic polypeptide
GSSFLSPEHQRVQQRKESKKPPAKLQPRGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1254 - protein, 317 aa, Artificial Sequence
  Description of Artificial Sequence: Synthetic polypeptide
GSSFLSPEHQRVQQRKESKKPPAKLQPRGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1255 - protein, 533 aa, Artificial Sequence
  Description of Artificial Sequence: Synthetic polypeptide
GSSFLSPEHQRVQQRKESKKPPAKLQPRGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1256 - protein, 569 aa, Artificial Sequence
  Description of Artificial Sequence: Synthetic polypeptide
GSSFLSPEHQRVQQRKESKKPPAKLQPRGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1257 - protein, 605 aa, Artificial Sequence
  Description of Artificial Sequence: Synthetic polypeptide
GSSFLSPEHQRVQQRKESKKPPAKLQPRGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1258 - protein, 605 aa, Artificial Sequence
  Description of Artificial Sequence: Synthetic polypeptide
GSSFLSPEHQRVQQRKESKKPPAKLQPRGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1259 - protein, 605 aa, Artificial Sequence
  Description of Artificial Sequence: Synthetic polypeptide
GSSFLSPEHQRVQQRKESKKPPAKLQPRGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1260 - protein, 865 aa, Artificial Sequence
  Description of Artificial Sequence: Synthetic polypeptide
GSSFLSPEHQRVQQRKESKKPPAKLQPRGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1261 - protein, 893 aa, Artificial Sequence
  Description of Artificial Sequence: Synthetic polypeptide
GSSFLSPEHQRVQQRKESKKPPAKLQPRGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1262 - protein, 904 aa, Artificial Sequence
  Description of Artificial Sequence: Synthetic polypeptide
  MOD_RES (459)..(461): Any amino acid
  MOD_RES (472)..(475): Any amino acid
GSSFLSPEHQRVQQRKESKKPPAKLQPRGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1263 - protein, 893 aa, Artificial Sequence
  Description of Artificial Sequence: Synthetic polypeptide
GSSFLSPEHQRVQQRKESKKPPAKLQPRGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1264 - protein, 904 aa, Artificial Sequence
  Description of Artificial Sequence: Synthetic polypeptide
GSSFLSPEHQRVQQRKESKKPPAKLQPRGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1265 - protein, 1347 aa, Artificial Sequence
  Description of Artificial Sequence: Synthetic polypeptide
GSSFLSPEHQRVQQRKESKKPPAKLQPRGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1266 - protein, 893 aa, Artificial Sequence
  Description of Artificial Sequence: Synthetic polypeptide
GSSFLSPEHQRVQQRKESKKPPAKLQPRGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1267 - protein, 893 aa, Artificial Sequence
  Description of Artificial Sequence: Synthetic polypeptide
GSSFLSPEHQRVQQRKESKKPPAKLQPRGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1268 - protein, 173 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGGSSFLSPEHQRVQQRKESKKPPAKLQPR

SEQ ID NO: 1269 - protein, 173 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGSSFLSPEHQRVQQRKESKKPPAKLQPR

SEQ ID NO: 1270 - protein, 317 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGSSFLSPEHQRVQQRKESKKPPAKLQPR

SEQ ID NO: 1271 - protein, 533 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGGSSFLSPEHQRVQQRKESKKPPAKLQPR

SEQ ID NO: 1272 - protein, 569 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGGSSFLSPEHQRVQQRKESKKPPAKLQPR

SEQ ID NO: 1273 - protein, 605 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGGSSFLSPEHQRVQQRKESKKPPAKLQPR

SEQ ID NO: 1274 - protein, 605 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGSSFLSPEHQRVQQRKESKKPPAKLQPR

SEQ ID NO: 1275 - protein, 605 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGGSSFLSPEHQRVQQRKESKKPPAKLQPR

SEQ ID NO: 1276 - protein, 865 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGGSSFLSPEHQRVQQRKESKKPPAKLQPR

SEQ ID NO: 1277 - protein, 893 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGSSFLSPEHQRVQQRKESKKPPAKLQPR

SEQ ID NO: 1278 - protein, 904 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGGSSFLSPEHQRVQQRKESKKPPAKLQPR

SEQ ID NO: 1279 - protein, 893 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGSSFLSPEHQRVQQRKESKKPPAKLQPR

SEQ ID NO: 1280 - protein, 904 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGSSFLSPEHQRVQQRKESKKPPAKLQPR

SEQ ID NO: 1281 - protein, 942 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGSSFLSPEHQRVQQRKESKKPPAKLQPR

SEQ ID NO: 1282 - protein, 953 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGSSFLSPEHQRVQQRKESKKPPAKLQPR

SEQ ID NO: 1283 - protein, 1347 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGGSSFLSPEHQRVQQRKESKKPPAKLQPR

SEQ ID NO: 1284 - protein, 893 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGGSSFLSPEHQRVQQRKESKKPPAKLQPR

SEQ ID NO: 1285 - protein, 893 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGGSSFLSPEHQRVQQRKESKKPPAKLQPR

SEQ ID NO: 1286 - protein, 176 aa, Artificial Sequence
  Description of Artificial Sequence: Synthetic polypeptide
HAEGTFTSDVSSTLEGQAALEFIAWLVKGRGGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1287 - protein, 176 aa, Artificial Sequence
  Description of Artificial Sequence: Synthetic polypeptide
HAEGTFTSDVSSTLEGQAALEFIAWLVKGRGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1288 - protein, 320 aa, Artificial Sequence
  Description of Artificial Sequence: Synthetic polypeptide
HAEGTFTSDVSSTLEGQAALEFIAWLVKGRGGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1289 - protein, 536 aa, Artificial Sequence
  Description of Artificial Sequence: Synthetic polypeptide
HAEGTFTSDVSSTLEGQAALEFIAWLVKGRGGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1290 - protein, 572 aa, Artificial Sequence
  Description of Artificial Sequence: Synthetic polypeptide
HAEGTFTSDVSSTLEGQAALEFIAWLVKGRGGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1291 - protein, 608 aa, Artificial Sequence
  Description of Artificial Sequence: Synthetic polypeptide
HAEGTFTSDVSSTLEGQAALEFIAWLVKGRGGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1292 - protein, 608 aa, Artificial Sequence
  Description of Artificial Sequence: Synthetic polypeptide
HAEGTFTSDVSSTLEGQAALEFIAWLVKGRGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1293 - protein, 608 aa, Artificial Sequence
  Description of Artificial Sequence: Synthetic polypeptide
HAEGTFTSDVSSTLEGQAALEFIAWLVKGRGGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1294 - protein, 868 aa, Artificial Sequence
  Description of Artificial Sequence: Synthetic polypeptide
HAEGTFTSDVSSTLEGQAALEFIAWLVKGRGGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1295 - protein, 896 aa, Artificial Sequence
  Description of Artificial Sequence: Synthetic polypeptide
HAEGTFTSDVSSTLEGQAALEFIAWLVKGRGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1296 - protein, 907 aa, Artificial Sequence
  Description of Artificial Sequence: Synthetic polypeptide
  MOD_RES (462)..(464): Any amino acid
  MOD_RES (475)..(478): Any amino acid
HAEGTFTSDVSSTLEGQAALEFIAWLVKGRGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1297 - protein, 896 aa, Artificial Sequence
  Description of Artificial Sequence: Synthetic polypeptide
HAEGTFTSDVSSTLEGQAALEFIAWLVKGRGGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1298 - protein, 907 aa, Artificial Sequence
  Description of Artificial Sequence: Synthetic polypeptide
HAEGTFTSDVSSTLEGQAALEFIAWLVKGRGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1299 - protein, 1350 aa, Artificial Sequence
  Description of Artificial Sequence: Synthetic polypeptide
HAEGTFTSDVSSTLEGQAALEFIAWLVKGRGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1300 - protein, 896 aa, Artificial Sequence
  Description of Artificial Sequence: Synthetic polypeptide
HAEGTFTSDVSSTLEGQAALEFIAWLVKGRGGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1301 - protein, 896 aa, Artificial Sequence
  Description of Artificial Sequence: Synthetic polypeptide
HAEGTFTSDVSSTLEGQAALEFIAWLVKGRGGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1302 - protein, 176 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGHAEGTFTSDVSSTLEGQAALEFIAWLVKGRG

SEQ ID NO: 1303 - protein, 176 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHAEGTFTSDVSSTLEGQAALEFIAWLVKGRG

SEQ ID NO: 1304 - protein, 320 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHAEGTFTSDVSSTLEGQAALEFIAWLVKGRG

SEQ ID NO: 1305 - protein, 536 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGHAEGTFTSDVSSTLEGQAALEFIAWLVKGRG

SEQ ID NO: 1306 - protein, 572 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGHAEGTFTSDVSSTLEGQAALEFIAWLVKGRG

SEQ ID NO: 1307 - protein, 608 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHAEGTFTSDVSSTLEGQAALEFIAWLVKGRG

SEQ ID NO: 1308 - protein, 608 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHAEGTFTSDVSSTLEGQAALEFIAWLVKGRG

SEQ ID NO: 1309 - protein, 608 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHAEGTFTSDVSSTLEGQAALEFIAWLVKGRG

SEQ ID NO: 1310 - protein, 868 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHAEGTFTSDVSSTLEGQAALEFIAWLVKGRG

SEQ ID NO: 1311 - protein, 896 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHAEGTFTSDVSSTLEGQAALEFIAWLVKGRG

SEQ ID NO: 1312 - protein, 907 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHAEGTFTSDVSSTLEGQAALEFIAWLVKGRG

SEQ ID NO: 1313 - protein, 896 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHAEGTFTSDVSSTLEGQAALEFIAWLVKGRG

SEQ ID NO: 1314 - protein, 907 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHAEGTFTSDVSSTLEGQAALEFIAWLVKGRG

SEQ ID NO: 1315 - protein, 945 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHAEGTFTSDVSSTLEGQAALEFIAWLVKGRG

SEQ ID NO: 1316 - protein, 956 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHAEGTFTSDVSSTLEGQAALEFIAWLVKGRG

SEQ ID NO: 1317 - protein, 1350 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGHAEGTFTSDVSSTLEGQAALEFIAWLVKGRG

SEQ ID NO: 1318 - protein, 896 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGHAEGTFTSDVSSTLEGQAALEFIAWLVKGRG

SEQ ID NO: 1319 - protein, 896 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGHAEGTFTSDVSSTLEGQAALEFIAWLVKGRG

SEQ ID NO: 1320 - protein, 215 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1321 - protein, 215 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1322 - protein, 359 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1323 - protein, 575 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1324 - protein, 611 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1325 - protein, 647 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1326 - protein, 647 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1327 - protein, 647 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1328 - protein, 907 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1329 - protein, 935 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1330 - protein, 946 aa, Artificial Sequence
  Description of Artificial Sequence: Synthetic polypeptide
  MOD_RES (501)..(503): Any amino acid
  MOD_RES (514)..(517): Any amino acid
GPETLCGAELVDALQFVCGDRGFYFNKPTGYGSSSRRAPQTGIVDECCFRSCDLRRLEMYCAPLKPAKSAGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1331 - protein, 935 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1332 - protein, 946 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1333 - protein, 1389 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1334 - protein, 935 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1335 - protein, 935 aa, Artificial Sequence
  Description of Artificial Sequence: Synthetic polypeptide
GPETLCGAELVDALQFVCGDRGFYFNKPTGYGSSSRRAPQTGIVDECCFRSCDLRRLEMYCAPLKPAKSAGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1336 - protein, 215 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGGPETLCGAELVDALQFVCGDRGFYFNKPTGYGSSSRRAPQTGIVDECCFRSCDLRRLEMYCAPLKPAKSA

SEQ ID NO: 1337 - protein, 215 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1338 - protein, 359 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1339 - protein, 575 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGGPETLCGAELVDALQFVCGDRGFYFNKPTGYGSSSRRAPQTGIVDECCFRSCDLRRLEMYCAPLKPAKSA

SEQ ID NO: 1340 - protein, 611 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGGPETLCGAELVDALQFVCGDRGFYFNKPTGYGSSSRRAPQTGIVDECCFRSCDLRRLEMYCAPLKPAKSA

SEQ ID NO: 1341 - protein, 647 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGGPETLCGAELVDALQFVCGDRGFYFNKPTGYGSSSRRAPQTGIVDECCFRSCDLRRLEMYCAPLKPAKSA

SEQ ID NO: 1342 - protein, 647 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1343 - protein, 647 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGGPETLCGAELVDALQFVCGDRGFYFNKPTGYGSSSRRAPQTGIVDECCFRSCDLRRLEMYCAPLKPAKSA

SEQ ID NO: 1344 - protein, 907 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGGPETLCGAELVDALQFVCGDRGFYFNKPTGYGSSSRRAPQTGIVDECCFRSCDLRRLEMYCAPLKPAKSA

SEQ ID NO: 1345 - protein, 935 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1346 - protein, 946 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGGPETLCGAELVDALQFVCGDRGFYFNKPTGYGSSSRRAPQTGIVDECCFRSCDLRRLEMYCAPLKPAKSA

SEQ ID NO: 1347 - protein, 935 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGGPETLCGAELVDALQFVCGDRGFYFNKPTGYGSSSRRAPQTGIVDECCFRSCDLRRLEMYCAPLKPAKSA

SEQ ID NO: 1348 - protein, 946 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1349 - protein, 984 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1350 - protein, 995 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1351 - protein, 1389 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGGPETLCGAELVDALQFVCGDRGFYFNKPTGYGSSSRRAPQTGIVDECCFRSCDLRRLEMYCAPLKPAKSA

SEQ ID NO: 1352 - protein, 935 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGGPETLCGAELVDALQFVCGDRGFYFNKPTGYGSSSRRAPQTGIVDECCFRSCDLRRLEMYCAPLKPAKSA

SEQ ID NO: 1353 - protein, 935 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGGPETLCGAELVDALQFVCGDRGFYFNKPTGYGSSSRRAPQTGIVDECCFRSCDLRRLEMYCAPLKPAKSA

SEQ ID NO: 1354 - protein, 212 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1355 - protein, 212 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1356 - protein, 356 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1357 - protein, 572 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1358 - protein, 608 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1359 - protein, 644 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1360 - protein, 644 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1361 - protein, 644 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1362 - protein, 904 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1363 - protein, 932 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1364 - protein, 943 aa, Artificial Sequence
  Description of Artificial Sequence: Synthetic polypeptide
  MOD_RES (498)..(500): Any amino acid
  MOD_RES (511)..(514): Any amino acid
AYRPSETLCGGELVDTLQFVCGDRGFYFSRPASRVSRRSRGIVEECCFRSCDLALLETYCATPAKSEGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1365 - protein, 932 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1366 - protein, 943 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1367 - protein, 1386 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1368 - protein, 932 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1369 - protein, 932 aa, Artificial Sequence
  Description of Artificial Sequence: Synthetic polypeptide
AYRPSETLCGGELVDTLQFVCGDRGFYFSRPASRVSRRSRGIVEECCFRSCDLALLETYCATPAKSEGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1370 - protein, 212 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGAYRPSETLCGGELVDTLQFVCGDRGFYFSRPASRVSRRSRGIVEECCFRSCDLALLETYCATPAKSE

SEQ ID NO: 1371 - protein, 212 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGAYRPSETLCGGELVDTLQFVCGDRGFYFSRPASRVSRRSRGIVEECCFRSCDLALLETYCATPAKSE

SEQ ID NO: 1372 - protein, 356 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAYRPSETLCGGELVDTLQFVCGDRGFYFSRPASRVSRRSRGIVEECCFRSCDLALLETYCATPAKSE

SEQ ID NO: 1373 - protein, 572 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGAYRPSETLCGGELVDTLQFVCGDRGFYFSRPASRVSRRSRGIVEECCFRSCDLALLETYCATPAKSE

SEQ ID NO: 1374 - protein, 608 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGAYRPSETLCGGELVDTLQFVCGDRGFYFSRPASRVSRRSRGIVEECCFRSCDLALLETYCATPAKSE

SEQ ID NO: 1375 - protein, 644 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGAYRPSETLCGGELVDTLQFVCGDRGFYFSRPASRVSRRSRGIVEECCFRSCDLALLETYCATPAKSE

SEQ ID NO: 1376 - protein, 644 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAYRPSETLCGGELVDTLQFVCGDRGFYFSRPASRVSRRSRGIVEECCFRSCDLALLETYCATPAKSE

SEQ ID NO: 1377 - protein, 644 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGAYRPSETLCGGELVDTLQFVCGDRGFYFSRPASRVSRRSRGIVEECCFRSCDLALLETYCATPAKSE

SEQ ID NO: 1378 - protein, 904 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGAYRPSETLCGGELVDTLQFVCGDRGFYFSRPASRVSRRSRGIVEECCFRSCDLALLETYCATPAKSE

SEQ ID NO: 1379 - protein, 932 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAYRPSETLCGGELVDTLQFVCGDRGFYFSRPASRVSRRSRGIVEECCFRSCDLALLETYCATPAKSE

SEQ ID NO: 1380 - protein, 943 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGAYRPSETLCGGELVDTLQFVCGDRGFYFSRPASRVSRRSRGIVEECCFRSCDLALLETYCATPAKSE

SEQ ID NO: 1381 - protein, 932 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGAYRPSETLCGGELVDTLQFVCGDRGFYFSRPASRVSRRSRGIVEECCFRSCDLALLETYCATPAKSE

SEQ ID NO: 1382 - protein, 943 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGAYRPSETLCGGELVDTLQFVCGDRGFYFSRPASRVSRRSRGIVEECCFRSCDLALLETYCATPAKSE

SEQ ID NO: 1383 - protein, 981 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAYRPSETLCGGELVDTLQFVCGDRGFYFSRPASRVSRRSRGIVEECCFRSCDLALLETYCATPAKSE

SEQ ID NO: 1384 - protein, 992 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGAYRPSETLCGGELVDTLQFVCGDRGFYFSRPASRVSRRSRGIVEECCFRSCDLALLETYCATPAKSE

SEQ ID NO: 1385 - protein, 1386 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGAYRPSETLCGGELVDTLQFVCGDRGFYFSRPASRVSRRSRGIVEECCFRSCDLALLETYCATPAKSE

SEQ ID NO: 1386 - protein, 932 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGAYRPSETLCGGELVDTLQFVCGDRGFYFSRPASRVSRRSRGIVEECCFRSCDLALLETYCATPAKSE

SEQ ID NO: 1387 - protein, 932 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGAYRPSETLCGGELVDTLQFVCGDRGFYFSRPASRVSRRSRGIVEECCFRSCDLALLETYCATPAKSE

SEQ ID NO: 1388 - protein, 294 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1389 - protein, 294 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1390 - protein, 438 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1391 - protein, 654 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1392 - protein, 690 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1393 - protein, 726 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1394 - protein, 726 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1395 - protein, 726 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1396 - protein, 986 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1397 - protein, 1014 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1398 - protein, 1025 aa, Artificial Sequence
  Description of Artificial Sequence: Synthetic polypeptide
  MOD_RES (580)..(582): Any amino acid
  MOD_RES (593)..(596): Any amino acid
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1399 - protein, 1014 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1400 - protein, 1025 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1401 - protein, 1468 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1402 - protein, 1014 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1403 - protein, 1014 aa, Artificial Sequence
  Description of Artificial Sequence: Synthetic polypeptide
EESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKVGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1404 - protein, 294 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1405 - protein, 294 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1406 - protein, 438 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1407 - protein, 654 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1408 - protein, 690 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1409 - protein, 726 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1410 - protein, 726 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1411 - protein, 726 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1412 - protein, 986 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1413 - protein, 1014 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1414 - protein, 1025 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1415 - protein, 1014 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1416 - protein, 1025 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1417 - protein, 1063 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1418 - protein, 1074 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1419 - protein, 1468 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1420 - protein, 1014 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1421 - protein, 1014 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGEESQKKLPSSRITCPQGSVAYGSYCYSLILIPQTWSNAELSCQMHFSGHLAFLLSTGEITFVSSLVKNSLTAYQYIWIGLHDPSHGTLPNGSGWKWSSSNVLTFYNWERNPSIAADRGYCAVLSQKSGFQKWRDFNCENELPYICKFKV

SEQ ID NO: 1422 - protein, 192 aa, Artificial Sequence
  Description of Artificial Sequence: Synthetic polypeptide
TQAQLLRVGCVLGTCQVQNLSHRLWQLMGPAGRQDSAPVDPSSPHSYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1423 - protein, 192 aa, Artificial Sequence
  Description of Artificial Sequence: Synthetic polypeptide
TQAQLLRVGCVLGTCQVQNLSHRLWQLMGPAGRQDSAPVDPSSPHSYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1424 - protein, 336 aa, Artificial Sequence
  Description of Artificial Sequence: Synthetic polypeptide
TQAQLLRVGCVLGTCQVQNLSHRLWQLMGPAGRQDSAPVDPSSPHSYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1425 - protein, 552 aa, Artificial Sequence
  Description of Artificial Sequence: Synthetic polypeptide
TQAQLLRVGCVLGTCQVQNLSHRLWQLMGPAGRQDSAPVDPSSPHSYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1426 - protein, 588 aa, Artificial Sequence
  Description of Artificial Sequence: Synthetic polypeptide
TQAQLLRVGCVLGTCQVQNLSHRLWQLMGPAGRQDSAPVDPSSPHSYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1427 - protein, 624 aa, Artificial Sequence
  Description of Artificial Sequence: Synthetic polypeptide
TQAQLLRVGCVLGTCQVQNLSHRLWQLMGPAGRQDSAPVDPSSPHSYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1428 - protein, 624 aa, Artificial Sequence
  Description of Artificial Sequence: Synthetic polypeptide
TQAQLLRVGCVLGTCQVQNLSHRLWQLMGPAGRQDSAPVDPSSPHSYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1429 - protein, 624 aa, Artificial Sequence
  Description of Artificial Sequence: Synthetic polypeptide
TQAQLLRVGCVLGTCQVQNLSHRLWQLMGPAGRQDSAPVDPSSPHSYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1430 - protein, 884 aa, Artificial Sequence
  Description of Artificial Sequence: Synthetic polypeptide
TQAQLLRVGCVLGTCQVQNLSHRLWQLMGPAGRQDSAPVDPSSPHSYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1431 - protein, 912 aa, Artificial Sequence
  Description of Artificial Sequence: Synthetic polypeptide
TQAQLLRVGCVLGTCQVQNLSHRLWQLMGPAGRQDSAPVDPSSPHSYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1432 - protein, 923 aa, Artificial Sequence
  Description of Artificial Sequence: Synthetic polypeptide
  MOD_RES (478)..(480): Any amino acid
  MOD_RES (491)..(494): Any amino acid
TQAQLLRVGCVLGTCQVQNLSHRLWQLMGPAGRQDSAPVDPSSPHSYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1433 - protein, 912 aa, Artificial Sequence
  Description of Artificial Sequence: Synthetic polypeptide
TQAQLLRVGCVLGTCQVQNLSHRLWQLMGPAGRQDSAPVDPSSPHSYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1434 - protein, 923 aa, Artificial Sequence
  Description of Artificial Sequence: Synthetic polypeptide
TQAQLLRVGCVLGTCQVQNLSHRLWQLMGPAGRQDSAPVDPSSPHSYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1435 - protein, 1366 aa, Artificial Sequence
  Description of Artificial Sequence: Synthetic polypeptide
TQAQLLRVGCVLGTCQVQNLSHRLWQLMGPAGRQDSAPVDPSSPHSYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1436 - protein, 912 aa, Artificial Sequence
  Description of Artificial Sequence: Synthetic polypeptide
TQAQLLRVGCVLGTCQVQNLSHRLWQLMGPAGRQDSAPVDPSSPHSYGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1437 - protein, 912 aa, Artificial Sequence
  Description of Artificial Sequence: Synthetic polypeptide
TQAQLLRVGCVLGTCQVQNLSHRLWQLMGPAGRQDSAPVDPSSPHSYGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1438 - protein, 192 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGTQAQLLRVGCVLGTCQVQNLSHRLWQLMGPAGRQDSAPVDPSSPHSY

SEQ ID NO: 1439 - protein, 192 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGTQAQLLRVGCVLGTCQVQNLSHRLWQLMGPAGRQDSAPVDPSSPHSY

SEQ ID NO: 1440 - protein, 336 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTQAQLLRVGCVLGTCQVQNLSHRLWQLMGPAGRQDSAPVDPSSPHSY

SEQ ID NO: 1441 - protein, 552 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGTQAQLLRVGCVLGTCQVQNLSHRLWQLMGPAGRQDSAPVDPSSPHSY

SEQ ID NO: 1442 - protein, 588 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGTQAQLLRVGCVLGTCQVQNLSHRLWQLMGPAGRQDSAPVDPSSPHSY

SEQ ID NO: 1443 - protein, 624 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGTQAQLLRVGCVLGTCQVQNLSHRLWQLMGPAGRQDSAPVDPSSPHSY

SEQ ID NO: 1444 - protein, 624 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTQAQLLRVGCVLGTCQVQNLSHRLWQLMGPAGRQDSAPVDPSSPHSY

SEQ ID NO: 1445 - protein, 624 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGTQAQLLRVGCVLGTCQVQNLSHRLWQLMGPAGRQDSAPVDPSSPHSY

SEQ ID NO: 1446 - protein, 884 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGTQAQLLRVGCVLGTCQVQNLSHRLWQLMGPAGRQDSAPVDPSSPHSY

SEQ ID NO: 1447 - protein, 912 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTQAQLLRVGCVLGTCQVQNLSHRLWQLMGPAGRQDSAPVDPSSPHSY

SEQ ID NO: 1448 - protein, 923 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGTQAQLLRVGCVLGTCQVQNLSHRLWQLMGPAGRQDSAPVDPSSPHSY

SEQ ID NO: 1449 - protein, 912 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGTQAQLLRVGCVLGTCQVQNLSHRLWQLMGPAGRQDSAPVDPSSPHSY

SEQ ID NO: 1450 - protein, 923 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGTQAQLLRVGCVLGTCQVQNLSHRLWQLMGPAGRQDSAPVDPSSPHSY

SEQ ID NO: 1451 - protein, 961 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTQAQLLRVGCVLGTCQVQNLSHRLWQLMGPAGRQDSAPVDPSSPHSY

SEQ ID NO: 1452 - protein, 972 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGTQAQLLRVGCVLGTCQVQNLSHRLWQLMGPAGRQDSAPVDPSSPHSY

SEQ ID NO: 1453 - protein, 1366 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGTQAQLLRVGCVLGTCQVQNLSHRLWQLMGPAGRQDSAPVDPSSPHSY

SEQ ID NO: 1454 - protein, 912 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGTQAQLLRVGCVLGTCQVQNLSHRLWQLMGPAGRQDSAPVDPSSPHSY

SEQ ID NO: 1455 - protein, 912 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGTQAQLLRVGCVLGTCQVQNLSHRLWQLMGPAGRQDSAPVDPSSPHSY

SEQ ID NO: 1456 - protein, 291 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1457 - protein, 291 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1458 - protein, 435 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1459 - protein, 651 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1460 - protein, 687 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1461 - protein, 723 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1462 - protein, 723 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1463 - protein, 723 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1464 - protein, 983 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1465 - protein, 1011 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1466 - protein, 179 aa, Artificial Sequence; identical to SEQ ID NO: 1150
  Description of Artificial Sequence: Synthetic polypeptide

SEQ ID NO: 1467 - protein, 179 aa, Artificial Sequence; identical to SEQ ID NO: 1151
  Description of Artificial Sequence: Synthetic polypeptide

SEQ ID NO: 1468 - protein, 323 aa, Artificial Sequence; identical to SEQ ID NO: 1152
  Description of Artificial Sequence: Synthetic polypeptide

SEQ ID NO: 1469 - protein, 539 aa, Artificial Sequence; identical to SEQ ID NO: 1153
  Description of Artificial Sequence: Synthetic polypeptide

SEQ ID NO: 1470 - protein, 575 aa, Artificial Sequence; identical to SEQ ID NO: 1154
  Description of Artificial Sequence: Synthetic polypeptide

SEQ ID NO: 1471 - protein, 611 aa, Artificial Sequence; identical to SEQ ID NO: 1155
  Description of Artificial Sequence: Synthetic polypeptide

SEQ ID NO: 1472 - protein, 611 aa, Artificial Sequence; identical to SEQ ID NO: 1156
  Description of Artificial Sequence: Synthetic polypeptide

SEQ ID NO: 1473 - protein, 611 aa, Artificial Sequence; identical to SEQ ID NO: 1157
  Description of Artificial Sequence: Synthetic polypeptide

SEQ ID NO: 1474 - protein, 871 aa, Artificial Sequence; identical to SEQ ID NO: 1158
  Description of Artificial Sequence: Synthetic polypeptide

SEQ ID NO: 1475 - protein, 899 aa, Artificial Sequence; identical to SEQ ID NO: 1159
  Description of Artificial Sequence: Synthetic polypeptide

SEQ ID NO: 1476 - protein, 910 aa, Artificial Sequence; identical to SEQ ID NO: 1160
  Description of Artificial Sequence: Synthetic polypeptide
  MOD_RES (465)..(467): Any amino acid
  MOD_RES (478)..(481): Any amino acid

SEQ ID NO: 1477 - protein, 899 aa, Artificial Sequence; identical to SEQ ID NO: 1161
  Description of Artificial Sequence: Synthetic polypeptide

SEQ ID NO: 1478 - protein, 910 aa, Artificial Sequence; identical to SEQ ID NO: 1162
  Description of Artificial Sequence: Synthetic polypeptide

SEQ ID NO: 1479 - protein, 1353 aa, Artificial Sequence; identical to SEQ ID NO: 1163
  Description of Artificial Sequence: Synthetic polypeptide

SEQ ID NO: 1480 - protein, 899 aa, Artificial Sequence; identical to SEQ ID NO: 1164
  Description of Artificial Sequence: Synthetic polypeptide

SEQ ID NO: 1481 - protein, 899 aa, Artificial Sequence; identical to SEQ ID NO: 1165
  Description of Artificial Sequence: Synthetic polypeptide

SEQ ID NO: 1482 - protein, 179 aa, Artificial Sequence; identical to SEQ ID NO: 1166
  Description of Artificial Sequence: Synthetic polypeptide

SEQ ID NO: 1483 - protein, 179 aa, Artificial Sequence; identical to SEQ ID NO: 1167
  Description of Artificial Sequence: Synthetic polypeptide

SEQ ID NO: 1484 - protein, 323 aa, Artificial Sequence; identical to SEQ ID NO: 1168
  Description of Artificial Sequence: Synthetic polypeptide

SEQ ID NO: 1485 - protein, 539 aa, Artificial Sequence; identical to SEQ ID NO: 1169
  Description of Artificial Sequence: Synthetic polypeptide

SEQ ID NO: 1486 - protein, 575 aa, Artificial Sequence; identical to SEQ ID NO: 1170
  Description of Artificial Sequence: Synthetic polypeptide

SEQ ID NO: 1487 - protein, 611 aa, Artificial Sequence; identical to SEQ ID NO: 1171
  Description of Artificial Sequence: Synthetic polypeptide

SEQ ID NO: 1488 - protein, 611 aa, Artificial Sequence; identical to SEQ ID NO: 1172
  Description of Artificial Sequence: Synthetic polypeptide

SEQ ID NO: 1489 - protein, 611 aa, Artificial Sequence; identical to SEQ ID NO: 1173
  Description of Artificial Sequence: Synthetic polypeptide

SEQ ID NO: 1490 - protein, 871 aa, Artificial Sequence; identical to SEQ ID NO: 1174
  Description of Artificial Sequence: Synthetic polypeptide

SEQ ID NO: 1491 - protein, 899 aa, Artificial Sequence; identical to SEQ ID NO: 1175
  Description of Artificial Sequence: Synthetic polypeptide

SEQ ID NO: 1492 - protein, 910 aa, Artificial Sequence; identical to SEQ ID NO: 1176
  Description of Artificial Sequence: Synthetic polypeptide
  MOD_RES (430)..(432): Any amino acid
  MOD_RES (443)..(446): Any amino acid

SEQ ID NO: 1493 - protein, 899 aa, Artificial Sequence; identical to SEQ ID NO: 1177
  Description of Artificial Sequence: Synthetic polypeptide

SEQ ID NO: 1494 - protein, 910 aa, Artificial Sequence; identical to SEQ ID NO: 1178
  Description of Artificial Sequence: Synthetic polypeptide

SEQ ID NO: 1495 - protein, 948 aa, Artificial Sequence; identical to SEQ ID NO: 1179
  Description of Artificial Sequence: Synthetic polypeptide

SEQ ID NO: 1496 - protein, 1022 aa, Artificial Sequence
  Description of Artificial Sequence: Synthetic polypeptide
  MOD_RES (577)..(579): Any amino acid
  MOD_RES (590)..(593): Any amino acid
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1497 - protein, 1011 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1498 - protein, 1022 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1499 - protein, 1465 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1500 - protein, 1011 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1501 - protein, 1011 aa, Artificial Sequence
  Description of Artificial Sequence: Synthetic polypeptide
VPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGCGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1502 - protein, 291 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1503 - protein, 291 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1504 - protein, 435 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1505 - protein, 651 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1506 - protein, 687 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1507 - protein, 723 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1508 - protein, 723 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1509 - protein, 723 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1510 - protein, 983 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1511 - protein, 1011 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1512 - protein, 1022 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1513 - protein, 1011 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1514 - protein, 1022 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1515 - protein, 1060 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1516 - protein, 1071 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1517 - protein, 1465 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1518 - protein, 1011 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1519 - protein, 1011 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 1520 - protein, 170 aa, Artificial Sequence
  Description of Artificial Sequence: Synthetic polypeptide
FRVDEEFQSPFASQSRGYFLFRPRNGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1521 - protein, 170 aa, Artificial Sequence
  Description of Artificial Sequence: Synthetic polypeptide
FRVDEEFQSPFASQSRGYFLFRPRNGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1522 - protein, 314 aa, Artificial Sequence
  Description of Artificial Sequence: Synthetic polypeptide
FRVDEEFQSPFASQSRGYFLFRPRNGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1523 - protein, 530 aa, Artificial Sequence
  Description of Artificial Sequence: Synthetic polypeptide
FRVDEEFQSPFASQSRGYFLFRPRNGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1524 - protein, 566 aa, Artificial Sequence
  Description of Artificial Sequence: Synthetic polypeptide
FRVDEEFQSPFASQSRGYFLFRPRNGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1525 - protein, 602 aa, Artificial Sequence
  Description of Artificial Sequence: Synthetic polypeptide
FRVDEEFQSPFASQSRGYFLFRPRNGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1526 - protein, 602 aa, Artificial Sequence
  Description of Artificial Sequence: Synthetic polypeptide
FRVDEEFQSPFASQSRGYFLFRPRNGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1527 - protein, 602 aa, Artificial Sequence
  Description of Artificial Sequence: Synthetic polypeptide
FRVDEEFQSPFASQSRGYFLFRPRNGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1528 - protein, 862 aa, Artificial Sequence
  Description of Artificial Sequence: Synthetic polypeptide
FRVDEEFQSPFASQSRGYFLFRPRNGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1529 - protein, 890 aa, Artificial Sequence
  Description of Artificial Sequence: Synthetic polypeptide
FRVDEEFQSPFASQSRGYFLFRPRNGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1530 - protein, 901 aa, Artificial Sequence
  Description of Artificial Sequence: Synthetic polypeptide
  MOD_RES (456)..(458): Any amino acid
  MOD_RES (469)..(472): Any amino acid
FRVDEEFQSPFASQSRGYFLFRPRNGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1531 - protein, 890 aa, Artificial Sequence
  Description of Artificial Sequence: Synthetic polypeptide
FRVDEEFQSPFASQSRGYFLFRPRNGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1532 - protein, 901 aa, Artificial Sequence
  Description of Artificial Sequence: Synthetic polypeptide
FRVDEEFQSPFASQSRGYFLFRPRNGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1533 - protein, 1344 aa, Artificial Sequence
  Description of Artificial Sequence: Synthetic polypeptide
FRVDEEFQSPFASQSRGYFLFRPRNGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1534 - protein, 890 aa, Artificial Sequence
  Description of Artificial Sequence: Synthetic polypeptide
FRVDEEFQSPFASQSRGYFLFRPRNGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1535 - protein, 890 aa, Artificial Sequence
  Description of Artificial Sequence: Synthetic polypeptide
FRVDEEFQSPFASQSRGYFLFRPRNGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1536 - protein, 170 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGFRVDEEFQSPFASQSRGYFLFRPRN

SEQ ID NO: 1537 - protein, 170 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGFRVDEEFQSPFASQSRGYFLFRPRN

SEQ ID NO: 1538 - protein, 314 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFRVDEEFQSPFASQSRGYFLFRPRN

SEQ ID NO: 1539 - protein, 530 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGFRVDEEFQSPFASQSRGYFLFRPRN

SEQ ID NO: 1540 - protein, 566 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGFRVDEEFQSPFASQSRGYFLFRPRN

SEQ ID NO: 1541 - protein, 602 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFRVDEEFQSPFASQSRGYFLFRPRN

SEQ ID NO: 1542 - protein, 602 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFRVDEEFQSPFASQSRGYFLFRPRN

SEQ ID NO: 1543 - protein, 602 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFRVDEEFQSPFASQSRGYFLFRPRN

SEQ ID NO: 1544 - protein, 862 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFRVDEEFQSPFASQSRGYFLFRPRN

SEQ ID NO: 1545 - protein, 890 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFRVDEEFQSPFASQSRGYFLFRPRN

SEQ ID NO: 1546 - protein, 901 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFRVDEEFQSPFASQSRGYFLFRPRN

SEQ ID NO: 1547 - protein, 890 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFRVDEEFQSPFASQSRGYFLFRPRN

SEQ ID NO: 1548 - protein, 901 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFRVDEEFQSPFASQSRGYFLFRPRN

SEQ ID NO: 1549 - protein, 939 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFRVDEEFQSPFASQSRGYFLFRPRN

SEQ ID NO: 1550 - protein, 950 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFRVDEEFQSPFASQSRGYFLFRPRN

SEQ ID NO: 1551 - protein, 1344 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGFRVDEEFQSPFASQSRGYFLFRPRN

SEQ ID NO: 1552 - protein, 890 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGFRVDEEFQSPFASQSRGYFLFRPRN

SEQ ID NO: 1553 - protein, 890 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGFRVDEEFQSPFASQSRGYFLFRPRN

SEQ ID NO: 1554 - protein, 182 aa, Artificial Sequence
  Description of Artificial Sequence: Synthetic polypeptide
HSQGTFTSDYSKYLDSRRAQDFVQWLMNTKRNRNNIAGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1555 - protein, 182 aa, Artificial Sequence
  Description of Artificial Sequence: Synthetic polypeptide
HSQGTFTSDYSKYLDSRRAQDFVQWLMNTKRNRNNIAGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1556 - protein, 326 aa, Artificial Sequence
  Description of Artificial Sequence: Synthetic polypeptide
HSQGTFTSDYSKYLDSRRAQDFVQWLMNTKRNRNNIAGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1557 - protein, 542 aa, Artificial Sequence
  Description of Artificial Sequence: Synthetic polypeptide
HSQGTFTSDYSKYLDSRRAQDFVQWLMNTKRNRNNIAGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1558 - protein, 578 aa, Artificial Sequence
  Description of Artificial Sequence: Synthetic polypeptide
HSQGTFTSDYSKYLDSRRAQDFVQWLMNTKRNRNNIAGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1559 - protein, 614 aa, Artificial Sequence
  Description of Artificial Sequence: Synthetic polypeptide
HSQGTFTSDYSKYLDSRRAQDFVQWLMNTKRNRNNIAGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1560 - protein, 614 aa, Artificial Sequence
  Description of Artificial Sequence: Synthetic polypeptide
HSQGTFTSDYSKYLDSRRAQDFVQWLMNTKRNRNNIAGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1561 - protein, 614 aa, Artificial Sequence
  Description of Artificial Sequence: Synthetic polypeptide
HSQGTFTSDYSKYLDSRRAQDFVQWLMNTKRNRNNIAGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1562 - protein, 874 aa, Artificial Sequence
  Description of Artificial Sequence: Synthetic polypeptide
HSQGTFTSDYSKYLDSRRAQDFVQWLMNTKRNRNNIAGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1563 - protein, 902 aa, Artificial Sequence
  Description of Artificial Sequence: Synthetic polypeptide
HSQGTFTSDYSKYLDSRRAQDFVQWLMNTKRNRNNIAGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1564 - protein, 913 aa, Artificial Sequence
  Description of Artificial Sequence: Synthetic polypeptide
  MOD_RES (468)..(470): Any amino acid
  MOD_RES (481)..(484): Any amino acid
HSQGTFTSDYSKYLDSRRAQDFVQWLMNTKRNRNNIAGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1565 - protein, 902 aa, Artificial Sequence
  Description of Artificial Sequence: Synthetic polypeptide
HSQGTFTSDYSKYLDSRRAQDFVQWLMNTKRNRNNIAGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1566 - protein, 913 aa, Artificial Sequence
  Description of Artificial Sequence: Synthetic polypeptide
HSQGTFTSDYSKYLDSRRAQDFVQWLMNTKRNRNNIAGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1567 - protein, 1356 aa, Artificial Sequence
  Description of Artificial Sequence: Synthetic polypeptide
HSQGTFTSDYSKYLDSRRAQDFVQWLMNTKRNRNNIAGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1568 - protein, 902 aa, Artificial Sequence
  Description of Artificial Sequence: Synthetic polypeptide
HSQGTFTSDYSKYLDSRRAQDFVQWLMNTKRNRNNIAGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1569 - protein, 902 aa, Artificial Sequence
  Description of Artificial Sequence: Synthetic polypeptide
HSQGTFTSDYSKYLDSRRAQDFVQWLMNTKRNRNNIAGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1570 - protein, 182 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGHSQGTFTSDYSKYLDSRRAQDFVQWLMNTKRNRNNIA

SEQ ID NO: 1571 - protein, 182 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHSQGTFTSDYSKYLDSRRAQDFVQWLMNTKRNRNNIA

SEQ ID NO: 1572 - protein, 326 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTKRNRNNIA

SEQ ID NO: 1573 - protein, 542 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGHSQGTFTSDYSKYLDSRRAQDFVQWLMNTKRNRNNIA

SEQ ID NO: 1574 - protein, 578 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGHSQGTFTSDYSKYLDSRRAQDFVQWLMNTKRNRNNIA

SEQ ID NO: 1575 - protein, 614 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGHSQGTFTSDYSKYLDSRRAQDFVQWLMNTKRNRNNIA

SEQ ID NO: 1576 - protein, 614 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGHSQGTFTSDYSKYLDSRRAQDFVQWLMNTKRNRNNIA

SEQ ID NO: 1577 - protein, 614 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGHSQGTFTSDYSKYLDSRRAQDFVQWLMNTKRNRNNIA

SEQ ID NO: 1578 - protein, 874 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGHSQGTFTSDYSKYLDSRRAQDFVQWLMNTKRNRNNIA

SEQ ID NO: 1579 - protein, 902 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTKRNRNNIA

SEQ ID NO: 1580 - protein, 913 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGHSQGTFTSDYSKYLDSRRAQDFVQWLMNTKRNRNNIA

SEQ ID NO: 1581 - protein, 902 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGHSQGTFTSDYSKYLDSRRAQDFVQWLMNTKRNRNNIA

SEQ ID NO: 1582 - protein, 913 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTKRNRNNIA

SEQ ID NO: 1583 - protein, 951 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHSQGTFTSDYSKYLDSRRAQDFVQWLMNTKRNRNNIA

SEQ ID NO: 1584 - protein, 962 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGHSQGTFTSDYSKYLDSRRAQDFVQWLMNTKRNRNNIA

SEQ ID NO: 1585 - protein, 1356 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGHSQGTFTSDYSKYLDSRRAQDFVQWLMNTKRNRNNIA

SEQ ID NO: 1586 - protein, 902 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGHSQGTFTSDYSKYLDSRRAQDFVQWLMNTKRNRNNIA

SEQ ID NO: 1587 - protein, 902 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGHSQGTFTSDYSKYLDSRRAQDFVQWLMNTKRNRNNIA

SEQ ID NO: 1588 - protein, 181 aa, Artificial Sequence
  Description of Artificial Sequence: Synthetic polypeptide
YPIKPEAPGEDASPEELNRYYASLRHYLNLVTRQRYGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1589 - protein, 181 aa, Artificial Sequence
  Description of Artificial Sequence: Synthetic polypeptide
YPIKPEAPGEDASPEELNRYYASLRHYLNLVTRQRYGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1590 - protein, 325 aa, Artificial Sequence
  Description of Artificial Sequence: Synthetic polypeptide
YPIKPEAPGEDASPEELNRYYASLRHYLNLVTRQRYGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1591 - protein, 541 aa, Artificial Sequence
  Description of Artificial Sequence: Synthetic polypeptide
YPIKPEAPGEDASPEELNRYYASLRHYLNLVTRQRYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1592 - protein, 577 aa, Artificial Sequence
  Description of Artificial Sequence: Synthetic polypeptide
YPIKPEAPGEDASPEELNRYYASLRHYLNLVTRQRYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1593 - protein, 613 aa, Artificial Sequence
  Description of Artificial Sequence: Synthetic polypeptide
YPIKPEAPGEDASPEELNRYYASLRHYLNLVTRQRYGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1594 - protein, 613 aa, Artificial Sequence
  Description of Artificial Sequence: Synthetic polypeptide
YPIKPEAPGEDASPEELNRYYASLRHYLNLVTRQRYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1595 - protein, 613 aa, Artificial Sequence
  Description of Artificial Sequence: Synthetic polypeptide
YPIKPEAPGEDASPEELNRYYASLRHYLNLVTRQRYGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1596 - protein, 873 aa, Artificial Sequence
  Description of Artificial Sequence: Synthetic polypeptide
YPIKPEAPGEDASPEELNRYYASLRHYLNLVTRQRYGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1597 - protein, 901 aa, Artificial Sequence
  Description of Artificial Sequence: Synthetic polypeptide
YPIKPEAPGEDASPEELNRYYASLRHYLNLVTRQRYGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1598 - protein, 912 aa, Artificial Sequence
  Description of Artificial Sequence: Synthetic polypeptide
  MOD_RES (467)..(469): Any amino acid
  MOD_RES (480)..(483): Any amino acid
YPIKPEAPGEDASPEELNRYYASLRHYLNLVTRQRYGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1599 - protein, 901 aa, Artificial Sequence
  Description of Artificial Sequence: Synthetic polypeptide
YPIKPEAPGEDASPEELNRYYASLRHYLNLVTRQRYGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1600 - protein, 912 aa, Artificial Sequence
  Description of Artificial Sequence: Synthetic polypeptide
YPIKPEAPGEDASPEELNRYYASLRHYLNLVTRQRYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1601 - protein, 1355 aa, Artificial Sequence
  Description of Artificial Sequence: Synthetic polypeptide
YPIKPEAPGEDASPEELNRYYASLRHYLNLVTRQRYGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1602 - protein, 901 aa, Artificial Sequence
  Description of Artificial Sequence: Synthetic polypeptide
YPIKPEAPGEDASPEELNRYYASLRHYLNLVTRQRYGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1603 - protein, 901 aa, Artificial Sequence
  Description of Artificial Sequence: Synthetic polypeptide
YPIKPEAPGEDASPEELNRYYASLRHYLNLVTRQRYGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1604 - protein, 181 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGYPIKPEAPGEDASPEELNRYYASLRHYLNLVTRQRY

SEQ ID NO: 1605 - protein, 181 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGYPIKPEAPGEDASPEELNRYYASLRHYLNLVTRQRY

SEQ ID NO: 1606 - protein, 325 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYPIKPEAPGEDASPEELNRYYASLRHYLNLVTRQRY

SEQ ID NO: 1607 - protein, 541 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGYPIKPEAPGEDASPEELNRYYASLRHYLNLVTRQRY

SEQ ID NO: 1608 - protein, 577 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGYPIKPEAPGEDASPEELNRYYASLRHYLNLVTRQRY

SEQ ID NO: 1609 - protein, 613 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGYPIKPEAPGEDASPEELNRYYASLRHYLNLVTRQRY

SEQ ID NO: 1610 - protein, 613 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGYPIKPEAPGEDASPEELNRYYASLRHYLNLVTRQRY

SEQ ID NO: 1611 - protein, 613 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGYPIKPEAPGEDASPEELNRYYASLRHYLNLVTRQRY

SEQ ID NO: 1612 - protein, 873 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGYPIKPEAPGEDASPEELNRYYASLRHYLNLVTRQRY

SEQ ID NO: 1613 - protein, 901 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYPIKPEAPGEDASPEELNRYYASLRHYLNLVTRQRY

SEQ ID NO: 1614 - protein, 912 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGYPIKPEAPGEDASPEELNRYYASLRHYLNLVTRQRY

SEQ ID NO: 1615 - protein, 901 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGYPIKPEAPGEDASPEELNRYYASLRHYLNLVTRQRY

SEQ ID NO: 1616 - protein, 912 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYPIKPEAPGEDASPEELNRYYASLRHYLNLVTRQRY

SEQ ID NO: 1617 - protein, 950 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGYPIKPEAPGEDASPEELNRYYASLRHYLNLVTRQRY

SEQ ID NO: 1618 - protein, 961 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYPIKPEAPGEDASPEELNRYYASLRHYLNLVTRQRY

SEQ ID NO: 1619 - protein, 1355 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGYPIKPEAPGEDASPEELNRYYASLRHYLNLVTRQRY

SEQ ID NO: 1620 - protein, 901 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGYPIKPEAPGEDASPEELNRYYASLRHYLNLVTRQRY

SEQ ID NO: 1621 - protein, 901 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGYPIKPEAPGEDASPEELNRYYASLRHYLNLVTRQRY

SEQ ID NO: 1622 - protein, 186 aa, Artificial Sequence
  Description of Artificial Sequence: Synthetic polypeptide
IVLSLDVPIGLLQILLEQARARAAREQATTNARILARVGHCGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1623 - protein, 186 aa, Artificial Sequence
  Description of Artificial Sequence: Synthetic polypeptide
IVLSLDVPIGLLQILLEQARARAAREQATTNARILARVGHCGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1624 - protein, 330 aa, Artificial Sequence
  Description of Artificial Sequence: Synthetic polypeptide
IVLSLDVPIGLLQILLEQARARAAREQATTNARILARVGHCGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1625 - protein, 546 aa, Artificial Sequence
  Description of Artificial Sequence: Synthetic polypeptide
IVLSLDVPIGLLQILLEQARARAAREQATTNARILARVGHCGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1626 - protein, 582 aa, Artificial Sequence
  Description of Artificial Sequence: Synthetic polypeptide
IVLSLDVPIGLLQILLEQARARAAREQATTNARILARVGHCGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1627 - protein, 618 aa, Artificial Sequence
  Description of Artificial Sequence: Synthetic polypeptide
IVLSLDVPIGLLQILLEQARARAAREQATTNARILARVGHCGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1628 - protein, 618 aa, Artificial Sequence
  Description of Artificial Sequence: Synthetic polypeptide
IVLSLDVPIGLLQILLEQARARAAREQATTNARILARVGHCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1629 - protein, 618 aa, Artificial Sequence
  Description of Artificial Sequence: Synthetic polypeptide
IVLSLDVPIGLLQILLEQARARAAREQATTNARILARVGHCGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1630 - protein, 878 aa, Artificial Sequence
  Description of Artificial Sequence: Synthetic polypeptide
IVLSLDVPIGLLQILLEQARARAAREQATTNARILARVGHCGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1631 - protein, 906 aa, Artificial Sequence
  Description of Artificial Sequence: Synthetic polypeptide
IVLSLDVPIGLLQILLEQARARAAREQATTNARILARVGHCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1632 - protein, 917 aa, Artificial Sequence
  Description of Artificial Sequence: Synthetic polypeptide
  MOD_RES (472)..(474): Any amino acid
  MOD_RES (485)..(488): Any amino acid
IVLSLDVPIGLLQILLEQARARAAREQATTNARILARVGHCGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1633 - protein, 906 aa, Artificial Sequence
  Description of Artificial Sequence: Synthetic polypeptide
IVLSLDVPIGLLQILLEQARARAAREQATTNARILARVGHCGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1634 - protein, 917 aa, Artificial Sequence
  Description of Artificial Sequence: Synthetic polypeptide
IVLSLDVPIGLLQILLEQARARAAREQATTNARILARVGHCGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1635 - protein, 1360 aa, Artificial Sequence
  Description of Artificial Sequence: Synthetic polypeptide
IVLSLDVPIGLLQILLEQARARAAREQATTNARILARVGHCGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1636 - protein, 906 aa, Artificial Sequence
  Description of Artificial Sequence: Synthetic polypeptide
IVLSLDVPIGLLQILLEQARARAAREQATTNARILARVGHCGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1637 - protein, 906 aa, Artificial Sequence
  Description of Artificial Sequence: Synthetic polypeptide
IVLSLDVPIGLLQILLEQARARAAREQATTNARILARVGHCGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1638 - protein, 186 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGIVLSLDVPIGLLQILLEQARARAAREQATTNARILARVGHC

SEQ ID NO: 1639 - protein, 186 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGIVLSLDVPIGLLQILLEQARARAAREQATTNARILARVGHC

SEQ ID NO: 1640 - protein, 330 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGIVLSLDVPIGLLQILLEQARARAAREQATTNARILARVGHC

SEQ ID NO: 1641 - protein, 546 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGIVLSLDVPIGLLQILLEQARARAAREQATTNARILARVGHC

SEQ ID NO: 1642 - protein, 582 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGIVLSLDVPIGLLQILLEQARARAAREQATTNARILARVGHC

SEQ ID NO: 1643 - protein, 618 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGIVLSLDVPIGLLQILLEQARARAAREQATTNARILARVGHC

SEQ ID NO: 1644 - protein, 618 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGIVLSLDVPIGLLQILLEQARARAAREQATTNARILARVGHC

SEQ ID NO: 1645 - protein, 618 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGIVLSLDVPIGLLQILLEQARARAAREQATTNARILARVGHC

SEQ ID NO: 1646 - protein, 878 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGIVLSLDVPIGLLQILLEQARARAAREQATTNARILARVGHC

SEQ ID NO: 1647 - protein, 906 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGIVLSLDVPIGLLQILLEQARARAAREQATTNARILARVGHC

SEQ ID NO: 1648 - protein, 917 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGIVLSLDVPIGLLQILLEQARARAAREQATTNARILARVGHC

SEQ ID NO: 1649 - protein, 906 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGIVLSLDVPIGLLQILLEQARARAAREQATTNARILARVGHC

SEQ ID NO: 1650 - protein, 917 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGIVLSLDVPIGLLQILLEQARARAAREQATTNARILARVGHC

SEQ ID NO: 1651 - protein, 955 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGIVLSLDVPIGLLQILLEQARARAAREQATTNARILARVGHC

SEQ ID NO: 1652 - protein, 966 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGIVLSLDVPIGLLQILLEQARARAAREQATTNARILARVGHC

SEQ ID NO: 1653 - protein, 1360 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGIVLSLDVPIGLLQILLEQARARAAREQATTNARILARVGHC

SEQ ID NO: 1654 - protein, 906 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGIVLSLDVPIGLLQILLEQARARAAREQATTNARILARVGHC

SEQ ID NO: 1655 - protein, 906 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGIVLSLDVPIGLLQILLEQARARAAREQATTNARILARVGHC

SEQ ID NO: 1656 - protein, 183 aa, Artificial Sequence
  Description of Artificial Sequence: Synthetic polypeptide
FTLSLDVPTNIMNLLFNIAKAKNLRAQAAANAHLMAQIGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1657 - protein, 183 aa, Artificial Sequence
  Description of Artificial Sequence: Synthetic polypeptide
FTLSLDVPTNIMNLLFNIAKAKNLRAQAAANAHLMAQIGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 1658 - protein, 327 aa, Artificial Sequence
  Description of Artificial Sequence: Synthetic polypeptide
FTLSLDVPTNIMNLLFNIAKAKNLRAQAAANAHLMAQIGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1659 - protein, 543 aa, Artificial Sequence
  Description of Artificial Sequence: Synthetic polypeptide
FTLSLDVPTNIMNLLFNIAKAKNLRAQAAANAHLMAQIGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 1660 - protein, 579 aa, Artificial Sequence
  Description of Artificial Sequence: Synthetic polypeptide
FTLSLDVPTNIMNLLFNIAKAKNLRAQAAANAHLMAQIGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1661 - protein, 615 aa, Artificial Sequence
  Description of Artificial Sequence: Synthetic polypeptide
FTLSLDVPTNIMNLLFNIAKAKNLRAQAAANAHLMAQIGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 1662 - protein, 615 aa, Artificial Sequence
  Description of Artificial Sequence: Synthetic polypeptide
FTLSLDVPTNIMNLLFNIAKAKNLRAQAAANAHLMAQIGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1663 - protein, 615 aa, Artificial Sequence
  Description of Artificial Sequence: Synthetic polypeptide
FTLSLDVPTNIMNLLFNIAKAKNLRAQAAANAHLMAQIGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 1664 - protein, 875 aa, Artificial Sequence
  Description of Artificial Sequence: Synthetic polypeptide
FTLSLDVPTNIMNLLFNIAKAKNLRAQAAANAHLMAQIGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 1665 - protein, 903 aa, Artificial Sequence
  Description of Artificial Sequence: Synthetic polypeptide
FTLSLDVPTNIMNLLFNIAKAKNLRAQAAANAHLMAQIGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1666 - protein, 914 aa, Artificial Sequence
  Description of Artificial Sequence: Synthetic polypeptide
  MOD_RES (469)..(471): Any amino acid
  MOD_RES (482)..(485): Any amino acid
FTLSLDVPTNIMNLLFNIAKAKNLRAQAAANAHLMAQIGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1667 - protein, 903 aa, Artificial Sequence
  Description of Artificial Sequence: Synthetic polypeptide
FTLSLDVPTNIMNLLFNIAKAKNLRAQAAANAHLMAQIGGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1668 - protein, 914 aa, Artificial Sequence
  Description of Artificial Sequence: Synthetic polypeptide
FTLSLDVPTNIMNLLFNIAKAKNLRAQAAANAHLMAQIGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1669 - protein, 1357 aa, Artificial Sequence
  Description of Artificial Sequence: Synthetic polypeptide
FTLSLDVPTNIMNLLFNIAKAKNLRAQAAANAHLMAQIGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1670 - protein, 903 aa, Artificial Sequence
  Description of Artificial Sequence: Synthetic polypeptide
FTLSLDVPTNIMNLLFNIAKAKNLRAQAAANAHLMAQIGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 1671 - protein, 903 aa, Artificial Sequence
  Description of Artificial Sequence: Synthetic polypeptide
FTLSLDVPTNIMNLLFNIAKAKNLRAQAAANAHLMAQIGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 1672 - protein, 183 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGFTLSLDVPTNIMNLLFNIAKAKNLRAQAAANAHLMAQI

SEQ ID NO: 1673 - protein, 183 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGFTLSLDVPTNIMNLLFNIAKAKNLRAQAAANAHLMAQI

SEQ ID NO: 1674 - protein, 327 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFTLSLDVPTNIMNLLFNIAKAKNLRAQAAANAHLMAQI

SEQ ID NO: 1675 - protein, 543 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGFTLSLDVPTNIMNLLFNIAKAKNLRAQAAANAHLMAQI

SEQ ID NO: 1676 - protein, 579 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGFTLSLDVPTNIMNLLFNIAKAKNLRAQAAANAHLMAQI

SEQ ID NO: 1677 - protein, 615 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSGFTLSLDVPTNIMNLLFNIAKAKNLRAQAAANAHLMAQI

SEQ ID NO: 1678 - protein, 615 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGFTLSLDVPTNIMNLLFNIAKAKNLRAQAAANAHLMAQI

SEQ ID NO: 1679 - protein, 615 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPGFTLSLDVPTNIMNLLFNIAKAKNLRAQAAANAHLMAQI

SEQ ID NO: 1680 - protein, 875 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSGFTLSLDVPTNIMNLLFNIAKAKNLRAQAAANAHLMAQI

SEQ ID NO: 1681 - protein, 903 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFTLSLDVPTNIMNLLFNIAKAKNLRAQAAANAHLMAQI

SEQ ID NO: 1682 - protein, 914 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPGFTLSLDVPTNIMNLLFNIAKAKNLRAQAAANAHLMAQI

SEQ ID NO: 1683 - protein, 903 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPGFTLSLDVPTNIMNLLFNIAKAKNLRAQAAANAHLMAQI

SEQ ID NO: 1684 - protein, 914 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFTLSLDVPTNIMNLLFNIAKAKNLRAQAAANAHLMAQI

SEQ ID NO: 1685 - protein, 952 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFTLSLDVPTNIMNLLFNIAKAKNLRAQAAANAHLMAQI

SEQ ID NO: 1686 - protein, 963 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFTLSLDVPTNIMNLLFNIAKAKNLRAQAAANAHLMAQI

SEQ ID NO: 1687 - protein, 1357 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPGFTLSLDVPTNIMNLLFNIAKAKNLRAQAAANAHLMAQI

SEQ ID NO: 1688 - protein, 903 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAGFTLSLDVPTNIMNLLFNIAKAKNLRAQAAANAHLMAQI

SEQ ID NO: 1689 - protein, 903 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAGFTLSLDVPTNIMNLLFNIAKAKNLRAQAAANAHLMAQI

SEQ ID NO: 1690 - protein, 1089 aa, Artificial Sequence
  Description of Artificial Sequence: Synthetic polypeptide
HGEGTFTSDLSKQMEEEAVRLFIEWLKNGGPSSGAPPPSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGHGEGTFTSDLSKQMEEEAVRLFIEWLKNGGPSSGAPPPSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1691 - protein, 1492 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEKGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1692 - protein, 951 aa, Artificial Sequence
  Description of Artificial Sequence: Synthetic polypeptide
HSQGTFTSDYSKYLDSRRAQDFVQWLMNTKRNRNNIAGHSQGTFTSDYSKYLDSRRAQDFVQWLMNTKRNRNNIAGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1693 - protein, 998 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGYPIKPEAPGEDASPEELNRYYASLRHYLNLVTRQRYGYPIKPEAPGEDASPEELNRYYASLRHYLNLVTRQRY

SEQ ID NO: 1694 - protein, 1237 aa, Artificial Sequence
  Description of Artificial Sequence: Synthetic polypeptide
IVLSLDVPIGLLQILLEQARARAAREQATTNARILARVGHCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGIVLSLDVPIGLLQILLEQARARAAREQATTNARILARVGHCGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1695 - protein, 349 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHSQGTFTSDYSKYLDSRRAQDFVQWLMNTGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGHSQGTFTSDYSKYLDSRRAQDFVQWLMNT

SEQ ID NO: 1696 - protein, 1384 aa, Artificial Sequence
  Description of Artificial Sequence: Synthetic polypeptide
CGNLSTCMLGTYTQDFNKFHTFPQTAIGVGAPGCGNLSTCMLGTYTQDFNKFHTFPQTAIGVGAPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1697 - protein, 1440 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYASGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1698 - protein, 1151 aa, Artificial Sequence
  Description of Artificial Sequence: Synthetic polypeptide
QLGPQGPPHLVADPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGQLGPQGPPHLVADPSKKQGPWLEEEEEAYGWMDFGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 1699 - protein, 1055 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGPETLCGAELVDALQFVCGDRGFYFNKPTGYGSSSRRAPQTGIVDECCFRSCDLRRLEMYCAPLKPAKSAGGPETLCGAELVDALQFVCGDRGFYFNKPTGYGSSSRRAPQTGIVDECCFRSCDLRRLEMYCAPLKPAKSA

SEQ ID NO: 1700 - protein, 627 aa, Artificial Sequence
  Description of Artificial Sequence: Synthetic polypeptide
HGEGTFTSDLSKQMEEEAVRLFIEWLKNGGPSSGAPPPSGGGLTPRSLLVGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 1701 - protein, 926 aa, Artificial Sequence
  Description of Artificial Sequence: Synthetic polypeptide
HGEGTFTSDLSKQMEEEAVRLFIEWLKNGGPSSGAPPPSGGGLGPVSGVPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1702 - protein, 915 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGLTPRSLLVGHGEGTFTSDLSKQMEEEAVRLFIEWLKNGGPSSGAPPPS

SEQ ID NO: 1703 - protein, 964 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAPLGLRLRGGGHGEGTFTSDLSKQMEEEAVRLFIEWLKNGGPSSGAPPPS

SEQ ID NO: 1704 - protein, 175 aa, Artificial Sequence
  Description of Artificial Sequence: Synthetic polypeptide
HSQGTFTSDYSKYLDSRRAQDFVQWLMNTGGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 1705 - protein, 185 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGVAGDSLEEGGGHSQGTFTSDYSKYLDSRRAQDFVQWLMNT

SEQ ID NO: 1706 - protein, 1393 aa, Artificial Sequence
  Description of Artificial Sequence: Synthetic polypeptide
HAEGTFTSDVSSTLEGQAALEFIAWLVKGRGGGGLTPRSLLVGHAEGTFTSDVSSTLEGQAALEFIAWLVKGRGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1707 - protein, 1243 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGVAGDSLEEGGGMRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 1708 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 1709 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXAGSPTSTEE

SEQ ID NO: 1710 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 1711 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 1712 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 1713 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXTPSGATGSP

SEQ ID NO: 1714 - protein, 5 aa, Unknown
  Description of Unknown: Sortase A cleavage site sequence
LPETG

SEQ ID NO: 1715 - protein, 12 aa, Unknown
  Description of Unknown: XTEN motif sequence
GSGASEPTSTEP

SEQ ID NO: 1716 - protein, 12 aa, Unknown
  Description of Unknown: XTEN motif sequence
GSEPATSGTEPS

SEQ ID NO: 1717 - protein, 12 aa, Unknown
  Description of Unknown: XTEN motif sequence
GTSEPSTSEPGA

SEQ ID NO: 1718 - protein, 12 aa, Unknown
  Description of Unknown: XTEN motif sequence
GTSTEPSEPGSA

SEQ ID NO: 1719 - protein, 12 aa, Unknown
  Description of Unknown: XTEN motif sequence
GSTAGSETSTEA

SEQ ID NO: 1720 - protein, 12 aa, Unknown
  Description of Unknown: XTEN motif sequence
GSETATSGSETA

SEQ ID NO: 1721 - protein, 12 aa, Unknown
  Description of Unknown: XTEN motif sequence
GTSESATSESGA

SEQ ID NO: 1722 - protein, 12 aa, Unknown
  Description of Unknown: XTEN motif sequence
GTSTEASEGSAS

SEQ ID NO: 1723 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 1724 - protein, 175 aa, Canis sp.
METCRCPLSYLISFLLFLPHSETACRLGKRPCRMQAFRIWDVNQKTFYLRNNQLVAGYLQGSNTKLEEKLDVVPVEPHAVFLGIHGGKLCLACVKSGDETRLQLEAVNITDLSKNKDQDKRFTFILSDSGPTTSFESAACPGWFLCTALEADRPVSLTNRPEEAMMVTKFYFQKE

SEQ ID NO: 1725 - protein, 176 aa, Unknown
  Description of Unknown: Rabbit sequence
MRPSRSTRRHLISLLLFLFHSETACRPSGKRPCRMQAFRIWDVNQKTFYLRNNQLVAGYLQGPNAKLEERIDVVPLEPQLLFLGIQRGKLCLSCVKSGDKMKLHLEAVNITDLGKNKEQDKRFTFIRSNSGPTTTFESASCPGWFLCTALEADQPVSLTNTPDDSIVVTKFYFQED

SEQ ID NO: 1726 - protein, 178 aa, Rattus sp.
MEICRGPYSHLISLLLILLFRSESAGHIPAGKRPCKMQAFRIWDTNQKTFYLRNNQLIAGYLQGPNTKLEEKIDMVPIDFRNVFLGIHGGKLCLSCVKSGDDTKLQLEEVNITDLNKNKEEDKRFTFIRSETGPTTSFESLACPGWFLCTTLEADHPVSLTNTPKEPCTVTKFYFQED

SEQ ID NO: 1727 - protein, 178 aa, Mus sp.
MEICWGPYSHLISLLLILLFHSEAACRPSGKRPCKMQAFRIWDTNQKTFYLRNNQLIAGYLQGPNIKLEEKIDMVPIDLHSVFLGIHGGKLCLSCAKSGDDIKLQLEEVNITDLSKNKEEDKRFTFIRSEKGPTTSFESAACPGWFLCTTLEADRPVSLTNTPEEPLIVTKFYFQEDQ

SEQ ID NO: 1728 - protein, 153 aa, Artificial Sequence
  Description of Artificial Sequence: Synthetic polypeptide
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 1729 - protein, 28 aa, Unknown
  Description of Unknown: Alpha-natriuretic peptide sequence
SLRRSSCFGGRMDRIGAQSGLGCNSFRY

SEQ ID NO: 1730 - protein, 32 aa, Homo sapiens
SPKMVQGSGGFGRKMDRISSSSGLGCKVLRRH

SEQ ID NO: 1731 - protein, 32 aa, Rattus sp.
NSKMAHSSSCFGQKIDRIGAVSRLGCDGLRLF

SEQ ID NO: 1732 - protein, 22 aa, Sus sp.
GLSKGCFGLKLDRIGSMSGLGC

SEQ ID NO: 1733 - protein, 146 aa, Unknown
  Description of Unknown: Fibroblast growth factor 2 sequence
PALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 1734 - protein, 235 aa, Unknown
  Description of Unknown: TNF receptor sequence
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 1735 - protein, 461 aa, Unknown
  Description of Unknown: FIX precursor sequence
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1736 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1737 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1738 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVNSYVTPICIADKEYTNIFLKFGSGYVSGWGRVFHKGRSALVLQYLRVPLVDRATCLRSTKFTIFNNMFCAGFHEGGRDSCQGDSGGPHVTEVEGTSFLTGIISWGEECAMKGKYGIYTKVSRYVNWIKEKTKLT

SEQ ID NO: 1739 - protein, 460 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVLNSYVTPICIADKEYTNIFLKFGSGYVSGWGRVFHKGRSALVLQYLRVPLVDATCLRSTKFTIFNNMFCAGFHEGGRDSCQGDSGGPHVTEVEGTSFLTGIVSWGEGCAMKGKYGIYTKVSRYVNWIKEKTKLT

SEQ ID NO: 1740 - protein, 462 aa, Homo sapiens
MQRVNMIMAESPSLITICLLGYLLSAECTVFLDHENANKILNRPKRYNSGKLEEFVQGNLERECMEEKCSFEEPREVFENTEKITEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNPTEAETILDNITQGTQSFNDFTRVVGGEDAKPGQFPWQVVLNGKVDAFCGGSIVNEKWIVTAAHCVETGVKITVVAGEHNIEETEHTEQKRNVIRAIIPHHNYNAAINKYNHDIALLELDEPLVLNSYVTPICIADKEYTNIFLKFGSGYVSGWARVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1741 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1742 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1743 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1744 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1745 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1746 - protein, 415 aa, Homo sapiens
YNSGKLEEFVQGNLERECMEEKCSFEEAREVFENTERTTEFWKQYVDGDQCESNPCLNGGSCKDDINSYECWCPFGFEGKNCELDATCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDAPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 1747 - protein, 406 aa, Unknown [sequence omitted]

SEQ ID NO: 1748 - protein, 28 aa, Artificial Sequence
  Description of Artificial Sequence: Synthetic peptide
PDVDYVNSTEAETILDNITQSTQSFNDF

SEQ ID NO: 1749 - protein, 7 aa, Artificial Sequence
  Description of Artificial Sequence: Synthetic peptide
KNSADNK

SEQ ID NO: 1750 - protein, 191 aa, Homo sapiens [sequence omitted]

SEQ ID NO: 1751 - protein, 190 aa, Sus scrofa
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 1752 - protein, 190 aa, Vicugna pacos
FPAMPLSSLFANAVLRAQHLHQLAADTYKEFERTYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILRQTYDKFDTNLRSDDALLKNYGLLSCFKKDLHKAETYLRVMKCRRFVESSCAF

SEQ ID NO: 1753 - protein, 190 aa, Camelus dromedarius; identical to SEQ ID NO: 1752

SEQ ID NO: 1754 - protein, 190 aa, Equus caballus
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVFGTSDRVYEKLRDLEEGIQALMRELEDGSPRAGQILKQTYDKFDTNLRSDDALLKNYGLLSCFKKDLHKAETYLRVMKCRRFVESSCAF

SEQ ID NO: 1755 - protein, 190 aa, Elephas maximus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRPGQVLKQTYDKFDTNMRSDDALLKNYGLLSCFKKDLHKAETYLRVMKCRRFVESSCAF

SEQ ID NO: 1756 - protein, 190 aa, Vulpes vulpes
FPAMPLSSLFANAVLRAQHLHQLAADTYKEFERAYIPEGQRYSIQNAQAAFCFSETIPAPTGKDEAQQRSDVELLRFSLVLIQSWLGPLQFLSRVFTNSLVFGTSDRVYEKLKDLEEGIQALMRELEDGSPRAGQILKQTYDKFDTNLRSDDALLKNYGLLSCFKKDLHKAETYLRVMKCRRFVESSCAF

SEQ ID NO: 1757 - protein, 190 aa, Canis sp.; identical to SEQ ID NO: 1751

SEQ ID NO: 1758 - protein, 190 aa, Felis catus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRGGQILKQTYDKFDTNLRSDDALLKNYGLLSCFKKDLHKAETYLRVMKCRRFVESSCAF

SEQ ID NO: 1759 - protein, 190 aa, Mustela vison
FPAMPLSSLFANAVLRAQHLHQLAADTYKDFERAYIPEGQRYSIQNAQAAFCFSETIPAPTGKDEAQQRSDMELLRFSLLLIQSWLGPVQFLSRVFTNSLVFGTSDRVYEKLKDLEEGIQALMRELEDGSPRAGPILKQTYDKFDTNLRSDDALLKNYGLLSCFKKDLHKAETYLRVMKCRRFVESSCAF

SEQ ID NO: 1760 - protein, 190 aa, Balaenoptera physalus
FPAMPLSSLFANAVLRAQHLHQLAADTYKEFERAYIPEGQRYSIQNAQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 1761 - protein, 190 aa, Delphinus delphis
FPAMPLSSLFANAVLRAQHLHQLAADTYKEFERAYIPEGQRYSIQNTQAAFCFSETIPAPTGKDEAQQRSDVELLRFSLLLIQSWLGPVQFLSRVFTNSLVFGTSDRVYEKLKDLEEGIQALMRELEDGSPRAGQILKQTYDKFDTNMRSDDALLKNYGLLSCFKKDLHKAETYLRVMKCRRFVESSCAF

SEQ ID NO: 1762 - protein, 190 aa, Hippopotamus amphibius; identical to SEQ ID NO: 1761

SEQ ID NO: 1763 - protein, 190 aa, Oryctolagus cuniculus
FPAMPLSSLFANAVLRAQHLHQLAADTYKEFERAYIPEGQRYSIQNAQAAFCFSETIPAPTGKDEAQQRSDMELLRFSLLLIQSWLGPVQFLSRAFTNTLVFGTSDRVYEKLKDLEEGIQALMRELEDGSPRVGQLLKQTYDKFDTNLRGDDALLKNYGLLSCFKKDLHKAETYLRVMKCRRFVESSCVF

SEQ ID NO: 1764 - protein, 190 aa, Rattus norvegicus
FPAMPLSSLFANAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRIGQILKQTYDKFDANMRSDDALLKNYGLLSCFKKDLHKAETYLRVMKCRRFAESSCAF

SEQ ID NO: 1765 - protein, 190 aa, Mus musculus
FPAMPLSSLFSNAVLRAQHLHQLAADTYKEFERAYIPEGQRYSIQNAQAAFCFSETIPAPTGKEEAQQRTDMELLRFSLLLIQSWLGPVQFLSRIFTNSLMFGTSDRVYEKLKDLEEGIQALMQELEDGSPRVGQILKQTYDKFDANMRSDDALLKNYGLLSCFKKDLHKAETYLRVMKCRRFVESSCAF

SEQ ID NO: 1766 - protein, 190 aa, Mesocricetus auratus
FPAMPLSSLFANAVLRAQHLHQLAADTYKEFERAYIPEGQRYSIQNAQTAFCFSETIPAPTGKEEAQQRSDMELLRFSLLLIQSWLGPVQFLSRIFTNSLMFGTSDRVYEKLKDLEEGIQALMQELEDGSPRVGQILKQTYDKFDTNMRSDDALLKNYGLLSCFKKDLHKAETYLRVMKCRRFVESSCAF

SEQ ID NO: 1767 - protein, 190 aa, Nannospalax ehrenbergi
FPAMPLSNLFANAVLRAQHLHQLAADTYKEFERAYIPEGQRYSIQNAQAAFCFSETIPAPTGKEEAQQRSDMELLRFSLLLIQSWLGPVQFLSRVFTNSLVFGTSDRVFEKLKDLEEGIQALMRELEDGSLRAGQLLKQTYDKFDTNMRSDDALLKNYGLLSCFKKDLHKAETYLRVMKCRRFVESSCAF

SEQ ID NO: 1768 - protein, 190 aa, Cavia porcellus
FPAMPLSSLFGNAVLRAQHLHQLAADTYKEFERTYIPEGQRYSIHNTQTAFCFSETIPAPTDKEEAQQRSDVELLHFSLLLIQSWLGPVQFLSRVFTNSLVFGTSDRVYEKLKDLEEGIQALMRELEDGTPRAGQILKQTYDKFDTNLRSNDALLKNYGLLSCFRKDLHRTETYLRVMKCRRFVESSCAF

SEQ ID NO: 1769 - protein, 191 aa, Unknown
  Description of Unknown: Ox sequence
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1770 - protein, 191 aa, Unknown
  Description of Unknown: Sheep or Goat sequence
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDVTPRAGQILKQTYDKFDTNMRSDDALLKNYGLLSCFRKDLHKTETYLRVMKCRRFGEASCAF

SEQ ID NO: 1771 - protein, 190 aa, Cervus elaphus
FPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1772 - protein, 191 aa, Giraffa camelopardalis
AFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFSNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 1773 - protein, 190 aa, Unknown
  Description of Unknown: Chevrotain-1 sequence
FPAMSLSGLFANAVLRVQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGPPRAGQILKQTYDKFDTNMRSDDALLKNYGLLSCFRKDLHKTETYLRVMKCRRFGEASCAF

SEQ ID NO: 1774 - protein, 190 aa, Nycticebus pygmaeus
FPAMPLSSLFANAVLRAQHLHQLAADTYKEFERAYIPEGQRYSIQNAQAAFCFSETIPAPTGKDEAQQRSDMELLRFSLLLIQSWLGPVQLLSRVFTNSLVLGTSDRVYEKLKDLEEGIQALMRELEDGSPRVGQILKQTYDKFDTNLRSDDALLKNYGLLSCFKKDLHKAETYLRVMKCRRFVESSCAF

SEQ ID NO: 1775 - protein, 191 aa, Callithrix jacchus
FPTIPLSRLLDNAMLRAHRLHQLAFDTYQEFEEAYIPKEQKYSFLQNPQTSLCFSESIPTPASKKETQQKSNLELLRMSLLLIQSWFEPVQFLRSVFANSLLYGVSDSDVYEYLKDLEEGIQTLMGRLEDGSPRTGEIFMQTYRKFDVNSQNNDALLKNYGLLYCFRKDMDKVETFLRIVQCRSVEGSCGF

SEQ ID NO: 1776 - protein, 190 aa, Trichosurus vulpecula
FPAMPLSSLFANAVLRAQHLHQLVADTYKEFERTYIPEAQRHSIQSTQTAFCFSETIPAPTGKDEAQQRSDVELLRFSLLLIQSWLSPVQFLSRVFTNSLVFGTSDRVYEKLRDLEEGIQALMQELEDGSSRGGLVLKTTYDKFDTNLRSDEALLKNYGLLSCFKKDLHKAETYLRVMKCRRFVESSCAF

SEQ ID NO: 1777 - protein, 191 aa, Macaca mulatta
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGTSYSDVYDLLKDLEEGIQTLMGRLEDGSSRTGQIFKQTYSKFDTNSHNNDALLKNYGLLYCFRKDMDKIETFLRIVQCRSVEGSCGF

SEQ ID NO: 1778 - protein, 4 aa, Artificial Sequence
  Description of Artificial Sequence: Synthetic peptide
LAEN

SEQ ID NO: 1779 - protein, 1018 aa, Artificial Sequence
  Description of Artificial Sequence: Synthetic polypeptide
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1780 - protein, 1029 aa, Artificial Sequence
  Description of Artificial Sequence: Synthetic polypeptide
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1781 - protein, 1111 aa, Artificial Sequence
  Description of Artificial Sequence: Synthetic polypeptide
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1782 - protein, 1100 aa, Artificial Sequence
  Description of Artificial Sequence: Synthetic polypeptide
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1783 - protein, 1149 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 1784 - protein, 1160 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 1785 - protein, 1341 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGKLTRVVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1786 - protein, 1348 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGKLTRVVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1787 - protein, 1337 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGKLTRVVGGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1788 - protein, 1348 aa, Artificial Sequence
  Description of Artificial Sequence: Synthetic polypeptide
  MOD_RES (903)..(905): Any amino acid
  MOD_RES (916)..(919): Any amino acid
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGKLTRVVGGGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1789 - protein, 1341 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTMTRIVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1790 - protein, 1791 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTMTRIVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1791 - protein, 1348 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTMTRIVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1792 - protein, 1337 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTMTRIVGGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1793 - protein, 1348 aa, Artificial Sequence
  Description of Artificial Sequence: Synthetic polypeptide
  MOD_RES (903)..(905): Any amino acid
  MOD_RES (916)..(919): Any amino acid
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGTMTRIVGGGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1794 - protein, 1341 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPFRVVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1795 - protein, 1791 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPFRVVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 1796 - protein, 1348 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPFRVVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1797 - protein, 1337 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPFRVVGGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1798 - protein, 1348 aa, Artificial Sequence
  Description of Artificial Sequence: Synthetic polypeptide
  MOD_RES (903)..(905): Any amino acid
  MOD_RES (916)..(919): Any amino acid
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGSPFRVVGGGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1799 - protein, 1341 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGLVQRIVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1800 - protein, 1348 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGLVQRIVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1801 - protein, 1337 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGLVQRIVGGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1802 - protein, 1348 aa, Artificial Sequence
  Description of Artificial Sequence: Synthetic polypeptide
  MOD_RES (903)..(905): Any amino acid
  MOD_RES (916)..(919): Any amino acid
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGLVQRIVGGGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1803 - protein, 1341 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGPLGRIVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 1804 - protein, 1348 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGPLGRIVGGGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1805 - protein, 1337 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGPLGRIVGGGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1806 - protein, 1348 aa, Artificial Sequence
  Description of Artificial Sequence: Synthetic polypeptide
  MOD_RES (903)..(905): Any amino acid
  MOD_RES (916)..(919): Any amino acid
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGPLGRIVGGGGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 1807 - protein, 1325 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1808 - protein, 1325 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAEGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1809 - protein, 1325 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1810 - protein, 1142 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTS

SEQ ID NO: 1811 - protein, 1282 aa, Artificial Sequence
  Description of Artificial Sequence: Synthetic polypeptide
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1812 - protein, 1067 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1813 - protein, 1105 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1814 - protein, 1116 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 1815 - protein, 1067 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 1816 - protein, 1056 aa, Artificial Sequence
  Description of Artificial Sequence: Synthetic polypeptide
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 1817 - protein, 1251 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

SEQ ID NO: 1818 - protein, 1395 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGFGGSPAGSPTSTEEGSPAGSPTSTEEGTSTEPSEGSAPGSEPATSGSETPGTSESATPESGPGSPAGSPTSTEEGSPAGSPTSTEEGTSTEPSEGSAPGTSTEPSEGSAPGSEPATSGSETPGTSESATPESGPGSEPATSGSETPGTSTEPSEGSAPGSEPATSGSETPGSPAGSPTSTEEGTSTEPSEGSAPGTSESATPESGPGTSESATPESGPGSEPATSGSETPGTSESATPESGPGTSTEPSEGSAPGTSESATPESGPGSEPATSGSETPGTSTEPSEGSAPG

SEQ ID NO: 1819 - protein, 1341 aa, Artificial Sequence; identical to SEQ ID NO: 1785
  Description of Artificial Sequence: Synthetic polypeptide

SEQ ID NO: 1820 - protein, 191 aa, Artificial Sequence
  Description of Artificial Sequence: Synthetic polypeptide
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTR

SEQ ID NO: 1821 - protein, 35 aa, Artificial Sequence
  Description of Artificial Sequence: Synthetic polypeptide
AETVFPDVDYVNSTEAETILDNITQSTQSFNDFTR

SEQ ID NO: 1822 - protein, 241 aa, Artificial Sequence
  Description of Artificial Sequence: Synthetic polypeptide
VVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGGKLTR

SEQ ID NO: 1823 - protein, 874 aa, Artificial Sequence
  Description of Artificial Sequence: Synthetic polypeptide
VVGGGGGGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

What is claimed is:

1. An isolated extended recombinant polypeptide (XTEN) comprising an amino acid sequence which has at least 90% sequence identity to a sequence selected from the group consisting of SEQ ID NOS: 204, 206, 210, 213, 216-219, 373-409, 684-698, 700-716, 762-769, 771, 774, and 777-780 wherein the XTEN comprises a motif selected from the group consisting of SEQ ID NO: 186, SEQ ID NO: 187, SEQ ID NO: 188, and SEQ ID NO: 189.

2. The isolated XTEN of claim 1, wherein the XTEN is further characterized in that:
   (a) the sum of asparagine and glutamine residues is less than 10% of the total amino acid sequence of the XTEN; and/or
   (b) the sum of methionine and tryptophan residues is less than 2% of the total amino acid sequence of the XTEN.

3. The isolated XTEN of claim 1, wherein the XTEN is further characterized in that:
   (a) no one type of amino acid constitutes more than 30% of the XTEN sequence;
   (b) the XTEN comprises a sequence in which no three contiguous amino acids are identical unless the amino acid is serine, in which case no more than three contiguous amino acids are serine residues; and/or
   (c) the XTEN sequence has a subsequence score of less than 10.

4. The isolated XTEN of claim 1, wherein the XTEN is further characterized in that the XTEN enhances pharmacokinetic properties of a biologically active protein (BP) when linked to the BP as a fusion protein wherein the pharmacokinetic properties are ascertained by measuring the blood concentration of the fusion protein after administration of a therapeutically effective dose to a subject in comparison to the corresponding BP not linked to XTEN and administered to a subject at a comparable dose.

5. The isolated XTEN of claim 4, wherein the enhanced pharmacokinetic property is selected from an increase in terminal half-life of at least three-fold and blood concentrations that remain within the therapeutic window for the fusion protein for a period at least about three-fold longer compared to the corresponding BP not linked to XTEN.

6. The isolated XTEN of claim 1, wherein the XTEN comprises an amino acid sequence at least 95% identical to a sequence selected from the group consisting of SEQ ID NOS: 204, 206, 210, 213, 216-219, 373-409, 684-698, 700-716, 762-769, 771, 774, and 777-780.

7. An isolated fusion protein, comprising the XTEN of claim 1 linked to a BP selected from the group consisting of glucose regulating peptide, metabolic protein, coagulation protein, and growth hormone.

8. The isolated fusion protein of claim 7, wherein the BP is glucose regulating peptide.

9. The isolated fusion protein of claim 8, wherein the glucose regulating peptide comprises an amino acid sequence at least 95% identical to a sequence selected from the group consisting of SEQ ID NOS: 11-24, 30, and 37-39.

10. The isolated fusion protein of claim 7, wherein the BP is metabolic protein.

11. The isolated fusion protein of claim 10, wherein the BP comprises an amino acid sequence at least 95% identical to a sequence selected from the group consisting of SEQ ID NOS: 1729-1734.

12. The isolated fusion protein of claim 7, wherein the BP is a coagulation factor.

13. The isolated fusion protein of claim 12, wherein the BP is factor IX.

14. The isolated fusion protein of claim 12, wherein the BP is factor VII or factor VIIa.

15. The isolated fusion protein of claim 7, wherein the BP is a growth hormone sequence at least 95% identical to SEQ ID NO: 1750.

16. An isolated fusion protein, comprising the XTEN of claim 1 linked to a BP exhibiting at least 90% sequence identity to a sequence selected from SEQ ID NOS: 1-42, 48-179, 1723-1747, and 1750-1777.

17. The isolated fusion protein of claim 7, further comprising a second XTEN sequence.

18. The isolated fusion protein of claim 7, further comprising a spacer sequence between the BP and XTEN, wherein the spacer sequence comprises between 1 to about 50 amino acid residues that optionally comprises a cleavage sequence.

19. The isolated fusion protein of claim 18, wherein the cleavage sequence is susceptible to cleavage by a protease selected from FXIa, FXIIa, kallikrein, FVIIa, FIXa, FXa, thrombin, elastase-2, granzyme B, MMP-12, MMP-13, MMP-17 or MMP-20, TEV, enterokinase, rhinovirus 3C protease, and sortase A.

20. An isolated fusion protein comprising a sequence that has at least 90% sequence identity to a sequence selected from SEQ ID NOS: 807-808, 812, 815, 818-819, 827-828, 832, 835, 838-841, 845-846, 850, 853, 856-857, 861-862, 866, 869, 872-875, 879-880, 884-885, 888, 891-892, 896-897, 901-902, 905, 908-911, 915-916, 920, 923, 926-927, 931-932, 936, 939, 942-945, 949-950, 954, 957, 960-961, 965-966, 970, 973, 976-979, 983-984, 988, 991, 994-995, 999-1000, 1004, 1007, 1010-1013, 1017-1018, 1022, 1025, 1028-1029, 1033-1034, 1038, 1041, 1044-1047, 1051-1052, 1056, 1059, 1062-1063, 1067-1068, 1072, 1075, 1078-1081, 1085-1086, 1090, 1093, 1096-1097, 1100-1101, 1105, 1108, 1111-1114, 1118-1119, 1123, 1126, 1129-1130, 1133-1134, 1138, 1141, 1144-1147, 1151-1152, 1156, 1159, 1162-1163, 1167-1168, 1172, 1175, 1178-1181, 1185-1186, 1190, 1193, 1196-1197, 1201-1202, 1206, 1209, 1212-1215, 1219-1220, 1224, 1227, 1230-1231, 1235-1236, 1240, 1243, 1246-1249, 1253-1254, 1258, 1261, 1264-1265, 1269-1270, 1274, 1277, 1280-1283, 1287-1288, 1292, 1295, 1298-1299, 1303-1304, 1308, 1311, 1314-1317, 1321-1322, 1326, 1329, 1332-1333, 1337-1338, 1342, 1345, 1348-1351, 1355-1356, 1360, 1363, 1366-1367, 1371-1372, 1376, 1379, 1382-1385, 1389-1390, 1394, 1397, 1400-1401, 1405-1406, 1410, 1413, 1416-1419, 1423-1424, 1428, 1431, 1434-1435, 1439-1440, 1444, 1447, 1450-1453, 1457-1458, 1462, 1465, 1467-1468, 1472, 1475, 1478-1479, 1483-1484, 1488, 1491, 1494-1495, 1498-1499, 1503-1504, 1508, 1511, 1514-1517, 1521-1522, 1526, 1529, 1532-1533, 1537-1538, 1542, 1545, 1548-1551, 1555-1556, 1560, 1563, 1566-1567, 1571-1572, 1576, 1579, 1582-1585, 1589-1590, 1594, 1597, 1600-1601, 1605-1606, 1610, 1613, 1616-1619, 1623-1624, 1628, 1631, 1634-1635, 1639-1640, 1644, 1647, 1650-1653, 1657-1658, 1662, 1665, 1668-1669, 1673-1674, 1678, 1681, 1684-1687, 1690-1697, 1699-1703, 1705-1707, 1779-1784, 1786-1787, 1790-1792, 1795-1797, 1800-1801, 1804-1805, 1807-1818.

21. A pharmaceutical composition comprising (i) the fusion protein of claim 7 or 20, and (ii) at least one pharmaceutically acceptable carrier.

22. An isolated nucleic acid comprising a polynucleotide sequence selected from (a) a polynucleotide encoding the XTEN of claim 1 or the fusion protein of claim 7 or 20, or (b) the complement of the polynucleotide of (a).

23. An expression vector comprising the polynucleotide sequence of claim 22.

24. The expression vector of claim 23, further comprising a recombinant regulatory sequence operably linked to the polynucleotide sequence.

25. The expression vector of claim 2, wherein the polynucleotide sequence is fused in frame to a polynucleotide encoding a secretion signal sequence.

26. The expression vector of claim 25, wherein the secretion signal sequence is a prokaryotic signal sequence.

27. A host cell, comprising the expression vector of claim 23.

28. The host cell of claim wherein the host cell is *E. coli*.

29. The host cell of claim 27, wherein the host cell is a CHO cell.

30. A kit, comprising packaging material, at least a first container comprising the pharmaceutical composition of claim 21, a label identifying the pharmaceutical composition and storage and handling conditions, and a sheet of instructions for the reconstitution and/or administration of the pharmaceutical compositions to a subject.

31. A method of treating a disease, disorder or condition, comprising administering a therapeutically effective dose of the pharmaceutical composition of claim 21 to a subject in need thereof, wherein the disease, disorder or condition is selected from type 1 diabetes, type 2 diabetes, obesity, hyperglycemia, hyperinsulinemia, decreased insulin production, insulin resistance, syndrome X, excessive appetite, insufficient satiety, glucagonomas, dyslipidemia, retinal neurodegenerative processes, Factor VII deficiency, Factor X deficiency, Factor XII deficiency, hemophilia A, hemophilia B, Von Willebrand's disease, hypertension, acute coronary syndrome, rheumatoid arthritis, reperfusion injury following ischemia, growth-hormone deficiency, Turner's Syndrome, Prader-Willi Syndrome, idiopathic short stature, AIDS wasting, multiple sclerosis, Crohn's disease, ulcerative colitis, muscular dystrophy, and surgical bleeding.

32. The method of claim 31, wherein the pharmaceutical composition is administered subcutaneously, intramuscularly, or intravenously.

33. The method of claim 31, wherein the therapeutically effective dose results in maintaining blood concentrations of the fusion protein within a therapeutic window for the fusion protein at least three-fold longer compared to the corresponding BP not linked to the fusion protein and administered at a comparable dose to a subject.

34. The method of claim 31, wherein multiple consecutive doses of the pharmaceutical composition are administered using a therapeutically effective dose regimen.

35. The method of claim 34, wherein the therapeutically effective dose regimen results in a gain in time of at least four-fold between at least two consecutive $C_{max}$ peaks and/or $C_{min}$ troughs for blood levels of the fusion protein compared to the corresponding BP not linked to the fusion protein and administered using a comparable dose regimen to a subject.

36. The method of claim 34, wherein the therapeutically effective dose regimen results in an improvement in at least one measured parameter in a subject using less frequent dosing or a lower total dosage in moles of the fusion protein of the pharmaceutical composition administered to the subject compared to the corresponding BP not linked to the fusion protein and administered to a subject.

37. The method of claim 36, wherein the one measured parameter is selected from fasting glucose level, response to oral glucose tolerance test, peak change of postprandial glucose from baseline, $HbA_{1c}$, caloric intake, satiety, rate of gastric emptying, insulin secretion, peripheral insulin sensitivity, response to insulin challenge, beta cell mass, body weight, prothrombin time, bleeding time, thrombin-antithrombin III complex (TAT), D-dimer, incidence of bleeding episodes, erythrocyte sedimentation rate (ESR), C-reactive protein, bone density, muscle mass, blood pressure, plasma triglycerides, HDL, cholesterol, LDL cholesterol, incidence of angina, and cardiac output.

\* \* \* \* \*